US009765315B2

(12) United States Patent
Alam et al.

(10) Patent No.: US 9,765,315 B2
(45) Date of Patent: Sep. 19, 2017

(54) **CELLULOSE AND/OR HEMICELLULOSES DEGRADING ENZYMES FROM *MACROPHOMINA PHASEOLINA* AND USES THEREOF**

(71) Applicant: Bangladesh Jute Research Institute, Dacca (BD)

(72) Inventors: Maqsudul Alam, Honolulu, HI (US); Mohammed S. Islam, Dacca (BD); Mohammed M. Hossen, Dacca (BD); Mohammed S. Haque, Dacca (BD); Mohammed M. Alam, Dacca (BD)

(73) Assignee: Bangladesh Jute Research Institute, Dhaka (BD)

( * ) Notice: Subject to any disclaimer, the term of this patent is extended or adjusted under 35 U.S.C. 154(b) by 34 days.

(21) Appl. No.: 14/421,774

(22) PCT Filed: Aug. 15, 2013

(86) PCT No.: PCT/US2013/055200
§ 371 (c)(1),
(2) Date: Feb. 13, 2015

(87) PCT Pub. No.: WO2014/028774
PCT Pub. Date: Feb. 20, 2014

(65) Prior Publication Data
US 2015/0291945 A1    Oct. 15, 2015

Related U.S. Application Data

(60) Provisional application No. 61/683,908, filed on Aug. 16, 2012.

(51) Int. Cl.
| | |
|---|---|
| *C07H 21/02* | (2006.01) |
| *C12N 9/42* | (2006.01) |
| *C12N 9/24* | (2006.01) |
| *C12N 9/26* | (2006.01) |
| *C12N 9/34* | (2006.01) |
| *C12N 9/38* | (2006.01) |
| *C12N 9/88* | (2006.01) |

(52) U.S. Cl.
CPC ......... *C12N 9/2402* (2013.01); *C12N 9/244* (2013.01); *C12N 9/2408* (2013.01); *C12N 9/2428* (2013.01); *C12N 9/2437* (2013.01); *C12N 9/2445* (2013.01); *C12N 9/2471* (2013.01); *C12N 9/2482* (2013.01); *C12N 9/2494* (2013.01); *C12N 9/88* (2013.01); *C12Y 302/0113* (2013.01); *C12Y 302/01037* (2013.01); *C12Y 302/01051* (2013.01); *C12Y 302/01055* (2013.01); *C12Y 302/01059* (2013.01); *C12Y 302/01075* (2013.01); *C12Y 302/01089* (2013.01); *C12Y 302/01177* (2013.01)

(58) Field of Classification Search
None
See application file for complete search history.

(56) References Cited

U.S. PATENT DOCUMENTS 7,572,950 B2   8/2009   Herbers et al.

FOREIGN PATENT DOCUMENTS

| WO | WO-03/000941 A2 | 1/2003 |
|---|---|---|
| WO | WO-2005/07869 A2 | 1/2005 |
| WO | WO-2006/012904 A1 | 2/2006 |
| WO | WO-2010/076388 A1 | 7/2010 |

OTHER PUBLICATIONS

Ngo et al. in The Protein Folding Problem and Tertiary Structure Prediction, 1994, Merz et al. (ed.), Birkhauser, Boston, MA, pp. 433 and 492-495.*
H. Guo et al.,( "Protein Tolerance to Random Amino Acid Change", PNAS 101(25): 9205-9210, Jun. 2004).*
International Preliminary Report on Patentability, dated Feb. 16, 2015, from corresponding International Application No. PCT/US2013/055200.
International Search Report, dated Mar. 25, 2014, from corresponding International Application No. PCT/US2013/055200.
UPI00006DE974, Feb. 9, 2006 XP055229506, URL:http://www.uniprot.org/uniparc/UPI00006DE974 [retrieved on Nov. 19, 2015].
UPI00032BD483, May 5, 2013, XP055229510,URL:http//www.uniprot.org/uniparc/UPI00032BD483 [retrieved on 22/19/2015].
Supplementary Partial European Search Report prepared on Nov. 19, 2015 for EP 13 82 9732.
Anagnostopoulos, C. et al., "Requirements for Transformation in *Bacillus subtilies*," J. Bacteriology 81:741-746 (1961).
Frandsen, R.JN. et al., "Efficient Four Fragment Cloning for the Construction of Vectors for Targeted Gene Replacement in Filamentous Fungi," BMC Molecular Biology, 9:70 (2008).
Li, Y. Y et al., "An Improved RNA Isolation Method for Filamentous Fungus *Blakeslea trispora* Rich in Polysaccharides," Appl Biochem Biotechnol, 160:322-327 (2010).
Medina, M.L. et al., "Analysis of Secreted Proteins from *Aspergillus flavus*", Proteomics, 5:3153-3161 (2005).
Valente, M.T. et al, "Pyrenochaeta Lycopersici Strain ISPaVe ER 1211 beta-1,4-endoglucanase (PLEGL1) mRNA", Curr. Genet., 57(4):241-251 (2011). GenBank Accession No. JN870922.1.

* cited by examiner

*Primary Examiner* — Richard Hutson
(74) *Attorney, Agent, or Firm* — Foley Hoag LLP

(57) ABSTRACT

The present invention provides nucleotide sequences of *Macrophomina phaseolina* ("M. phaseolina") that encodes proteins/enzymes with cellulolytic activity, including a cellulase activity, a endoglucanase, a cellobiohydrolase, a β-glucosidase, a a-glucosidase, a xylanase, a mannanse, a β-xylosidase, a a-xylosidase, a galactosidase, an arabinofuranosidase, a a-fucosidases, a β-galactanase, an unsaturated β-glucuronyl hydrolase and/or oligomerase activity. Vectors, expression constructs and host cells comprising and/or consisting of the nucleotide sequences of the enzyme genes are also provided. The invention further provides methods for producing the enzymes and methods for modifying the enzymes in order to improve their desirable characteristics. The enzymes of the invention can be used in a variety of, but not limited to, pharmaceutical, agricultural, food and feed processing, biofuel, energy efficiency and industrial contexts. These enzymes are also useful for complete hydrolysis of lignocellulosic biomass into simple sugar that can then be fermented to liquid fuels and chemical feedstocks.

13 Claims, 55 Drawing Sheets

1661 bp 864 bp 1150 bp 677 bp 1165 bp 839 bp

CELLULOSE AND/OR HEMICELLULOSES DEGRADING ENZYMES FROM *MACROPHOMINA PHASEOLINA* AND USES THEREOF

RELATED APPLICATIONS

This application is a National Stage application of PCT/US2013/055200 filed Aug. 15, 2013, which claims the benefit of priority to U.S. Provisional Patent Application Ser. No. 61/683,908, filed Aug. 16, 2012.

SEQUENCE LISTING

The instant application contains a Sequence Listing which has been submitted via EFS-Web and is hereby incorporated by reference in its entirety. Said ASCII copy is named JGX_701_ST25.txt and is 1220 kilobytes in size.

FIELD OF INVENTION

The present invention relates to cellulose and/or hemicelluloses degrading enzymes which are derivable from a fungus *M. phaseolina*. The invention provides polypeptides having any cellulolytic activity, including a cellulase activity, a endoglucanase, a cellobiohydrolase, a β-glucosidase, a α-glucosidase, a xylanase, a mannanse, a β-xylosidase, an arabinofuranosidase, a α-fucosidases, an unsaturated β-glucuronyl hydrolase and/or oligomerase activity, polynucleotides encoding the aforesaid polypeptides, and methods of making and using the aforesaid polynucleotides and polypeptides. The invention provides enzymes for the bioconversion of cellulosic residues into fermentable sugars and these sugars can be used as a chemical feedstock for the production of ethanol and fuels, including biofuels such as bioethanol, biopropanol, biobutanol and biodiesels. The polypeptides of the invention can be used in a variety of pharmaceutical, agricultural, food and feed processing, biofuel, energy efficiency and industrial contexts. The invention also provides compositions or products of manufacture comprising mixtures of enzymes having at least one enzyme of present invention. The invention also relates to nucleic acid constructs, vector and host cells comprising the polynucleotides as well as methods for producing and using the polypeptides which are used in cellulose and/or hemicellulose degradation.

BACKGROUND OF THE INVENTION

Cellulose consists of a linear chain of β1-4 linked D-glucose residues having a molecular structure as shown in FIG. 1. This long linear glucose chains are tightly bundled together in microfibrils and are non-covalently linked together by hemicelluloses (Kolpak F J, Blackwell J. Determination of the structure of cellulose II. Macromolecules 1976; 9:273-278; Carpita N C, Gibeaut D M. Structural models of primary cell walls in flowering plants: consistency of molecular structure with the physical properties of the walls during growth. Plant J 1993; 3:1-30). Cellulose forms crystalline, insoluble microfibrils in plant cell walls which are recalcitrant to enzymatic hydrolysis. This recalcitrance is the bottle-neck in cellulosic ethanol production (Himmel M, Ding S, Johnson D, Adney W, Nimlos M, Brady J W, Foust T D. Biomass recalcitrance: Engineering plants and enzymes for biofuels production. Science 2007; 315: 804). On the other hand hemicelluloses are the most complex group of non-starch polysaccharides and it consists of polymer of xylose, arabinose, galactose, mannose which are often highly branched and connected to other cell wall structure.

Cellulose, having been the most abundant biological material in the world, is a vast, renewable resource that could help meet the world's energy needs. But the production of fermentable sugars from biomass by using of cellulolytic enzymes is not yet able to compete economically due to the inefficiency of the currently used cellulolytic enzymes. There is a need for research aimed at increase efficacy of celluloytic enzymes that can be used to generate fermentable sugar from lignocellulosic materials with reduced cost. For complete digestion of cellulose to glucose the cellulase systems requires three classes of enzymes, β-1,4-endoglucanases (EGL), exoglucanases/cellobiohydrolases (CBH), and β-glucosidase (BGL). During hydrolysis process, endoglucanase first randomly cleaves different regions of crystalline cellulose, producing chain ends. Cellobiohydrolases then sequentially release cellobiose from the end of the cellulose polymer. Finally, β-glucosidase breaks the bonds between the two glucose sugars of cellobiose to produce monomers of glucose (FIG. 2). This synergistic effect of these enzymes makes possible the cellulose hydrolysis to glucose (Wood T M. Synergism between enzyme components of *Penicillium pinophilum* cellulase in solubilizing hydrogen bond ordered cellulose. J Biochem 1989; 260:37-43; Wood T M, McRae S T. The cellulase of *Trichoderma koningii*: purification and properties of some endoglucanase components with special reference to their action on cellulose when acting alone and in synergism with the cellobiohydrolase. J Biochem 1978; 171:61-9; Wood T M, McRae S T. Synergism between enzyme involved in the solubilization of the native cellulose. Adv Chem Ser 1979; 18:181-210). That is, at least three types of enzymes e.g. endoglucanases, cellobiohydrolases and β-glucosidase and their synergistic effect are required for complete digestion of cellulose. For each of these three enzymes different structural variants exist that perform the same function. Many more enzymes are required to digest hemicelluloses to monomer sugar including xylanase, xylosidase, arabinofuranosidase, mannanase, galactosidase and glucuronidase.

It is an object of the present invention to provide isolated polypeptides having cellulolytic activity and isolated nucleic acid sequences encoding the polypeptides to improve the conversion of cellulosic materials into fermentable sugar.

SUMMARY OF THE INVENTION

Among other things, the present invention discloses a polynucleotide molecule that encodes cellulolytic enzyme which is derived from a fungus *M. phaseolina*. The current invention also relates to the use of fungus *M. phaseolina* in the degradation of cellulosic materials.

The invention provides polypeptides having cellulolytic activity, including endoglucanase, cellobiohydrolase, β-glucosidase, α-glucosidase, glucanases, α-glucan lyase, α-xylosidase, β-xylosidase, d-4,5-unsaturated b-glucuronyl hydrolase, amyloglucosidase, mannosidase, α-fucosidase, arabinosidase, xylanase, mannanase, β-galactosidase, β-galactanase, arabinofuranosidase, and/or oligomerase activity, and nucleic acids encoding for each of the polypeptide, and methods for making and using of each of the said polypeptide.

The primary object of the present invention is to disclose the sets of nucleotides sequences encoding β-1,4-endoglucanase (SEQ ID Nos. 1, 2, 4, 5, 7, 8, 10, 11, 13, 14, 16, 17, 19, 20, 22, 23, 25, 26, 28, 29, 31, 32, 34, 35, 37, 38, 40, 41, 43, 44, 46 and 47), cellobiohydrolase (SEQ ID Nos. 49, 50, 52, 53, 55 and 56), β-glucosidase (SEQ ID Nos. 58, 59, 61, 62, 64, 65, 67, 68, 70, 71, 73, 74, 76, 77, 79, 80, 82, 83, 85, 86, 88, 89, 91, 92, 94, 95, 97, 98, 100, 101, 103, 104, 106, 107, 109, 110, 112, 113, 115 and 116), α-glucosidase (SEQ ID Nos. 118, 119, 121, 122, 124, 125, 127, 128, 130, 131, 133, 134, 136 and 137), Exo-1,3-β-glucanase (SEQ ID Nos. 139, 140, 142, 143, 145, 146, 148, 149, 151, 152, 154, 155, 157, 158, 160, 161, 163 and 164), α-glucan lyase (SEQ ID NOs. 166, 167, 169 and 170), α-xylosidase (SEQ ID Nos. 172, 173, 175 and 176), d-4,5-unsaturated b-glucuronyl hydrolase (SEQ ID Nos. 178, 179, 181, 182, 184, 185, 187, 188, 190 and 191), amyloglucosidase (SEQ ID Nos. 193, 194, 196 and 197), α-1,2-mannosidase (SEQ ID Nos. 199, 200, 202, 203, 205, 206, 208, 209, 211, 212, 214 and 215), α-1,3-glucanase (SEQ ID Nos. 217, 218, 220, 221, 223, 224, 226, 227, 229, 230, 232, 233, 235, 236, 238, 239, 241, 242, 244, 245, 247, 248, 250 and 251), α-fucosidase (SEQ ID Nos. 253, 254, 256 and 257), xylan 1,4-β-Xylosidase (SEQ ID Nos. 259, 260, 262, 263, 265, 266, 268, 269, 271, 272, 274, 275, 277, 278, 280, 281, 283, 284, 286, 287, 289 and 290), endo-1,5-α-arabinosidase (SEQ ID Nos. 292, 293, 295, 296, 298, 299, 301 and 302), Endo-1,4-β-xylanase (SEQ ID Nos. 304, 305, 307, 308, 310, 311, 313 and 314), α-arabinofuranosidase (SEQ ID Nos. 316, 317, 319, 320, 322, 323, 325, 326, 328, 329, 331 and 332), β-galactosidase (SEQ Nos. 334, 335, 337, 338, 340, 341, 343, 344, 346, 347, 349 and 350), Endo-1,4-β-galactanase (SEQ ID Nos. 352, 353, 355, 356, 358 and 359), Endo-1,6-β-glucanase (SEQ ID Nos. 361 and 362) and endo-β-1,4-mannanase (SEQ ID Nos. 364 and 365) of the fungi *M. phaseolina*. For each gene of the invention, an open reading frame (ORF) sequence was derived manually from the respective genomic sequence by deleting predicted intron sequences and splicing together exon sequences. Vectors, expression constructs/vectors, and host cells comprising the enzyme genes are also included.

In another object, the invention provides deduced polypeptide sequences from the ORF sequences of the genes. Based on the sequence conservation displayed between the *M. phaseolina* genes of the invention and their homologs in other fungi, it is concluded that the polypeptides encoded by these *M. phaseolina* genes exhibit enzymatic activities similar to their homologs. The polypeptide sequences of the invention correspond to those of β-1,4-endoglucanase (SEQ ID Nos. 3, 6, 9, 12, 15, 18, 21, 24, 27, 30, 33, 36, 39, 42, 45 and 48), cellobiohydrolase (SEQ ID Nos. 51, 54 and 57), β-glucosidase (SEQ ID Nos. 60, 63, 66, 69, 72, 75, 78, 81, 84, 87, 90, 93, 96, 99, 102, 105, 108, 111, 114 and 117), α-glucosidase (SEQ ID Nos. 120, 123, 126, 129, 132, 135 and 138), Exo-1,3-β-glucanase (SEQ ID Nos. 141, 144, 147, 150, 153, 156, 159, 162 and 165), α-glucan lyase (SEQ ID NOs. 168 and 171), α-xylosidase (SEQ ID Nos. 174 and 177), d-4,5-unsaturated b-glucuronyl hydrolase (SEQ ID Nos. 180, 183, 186, 189 and 192), amyloglucosidase (SEQ ID Nos. 195 and 198), α-1,2-mannosidase (SEQ ID Nos. 201, 204, 207, 210, 213 and 216), α-1,3-glucanase (SEQ ID Nos. 219, 222, 225, 228, 231, 234, 237, 240, 243, 246, 249 and 252), α-fucosidase (SEQ ID Nos. 255 and 258), xylan 1,4-β-Xylosidase (SEQ ID Nos. 261, 264, 267, 270, 273, 276, 279, 282, 285, 288 and 291), endo-1,5-α-arabinosidase (SEQ ID Nos. 294, 297, 300 and 303), Endo-1,4-β-xylanase (SEQ ID Nos. 306, 309, 312 and 315), α-arabinofuranosidase (SEQ ID Nos. 318, 321, 324, 327, 330 and 333), β-galactosidase (SEQ Nos. 336, 339, 342, 345, 348, and 351), Endo-1,4-β-galactanase (SEQ ID Nos. 354, 357 and 360), Endo-1,6-β-glucanase (SEQ ID Nos. 363) and endo-β-1,4-mannanase (SEQ ID Nos. 366). The present invention also relates to isolated polynucleotides comprising any complement of the nucleotide sequences described above.

In one aspect, the enzymes of the invention have an increased catalytic rate to improve the process of cellulose hydrolysis. This increased catalytic rate leads to an increased efficiency in producing fermentable sugars, which can be used by microorganisms for ethanol production. The invention provides industrial applications (e.g., biomass to ethanol) using enzymes of the invention having decreased costs in biomass to ethanol conversion processes. Thus, the invention provides efficient processes for producing bioethanol from any cellulosic materials.

In another aspect, the compositions and methods of the invention are used in the enzymatic digestion of biomass and can comprise use of many different enzymes, including the cellulases and hemicellulases.

In another aspect, compositions used to practice the invention include a "mixture of cellulase" that is a mixture of at least three different cellulase enzyme such as endoglucanase, cellobiohydrolase and β-glucosidase for complete digestion of cellulose to produce glucose monomer.

In another aspect, compositions used to practice the invention can include mixtures of enzymes, including xylanases, xylosidases, cellobiohydrolases, and/or arabinofuranosidases or other enzymes that can digest hemicellulose to monomer sugars.

In another aspect, the endoglucanases of the invention are used in the food industry, e.g., for baking and fruit and vegetable processing, breakdown of agricultural waste, in the manufacture of animal feed, in pulp and paper production, textile manufacture and household and industrial cleaning agents.

In another aspect the present invention also provide the molecular biology and genetic information of the genes and enzymes set forth in the primary object to be exploited/utilized for the regulation, conversion of cellulose and/or hemicelluloses degradation for the production of valuable products.

In another aspect, in order to facilitate in vitro production of the cellulose and/or hemicelluloses degrading polypeptide, the present invention include as well an expression construct capable of expressing polypeptide containing at least 70% sequential amino acids as set forth in SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366. Preferably, the expression construct has inserted DNA or cDNA with sequential nucleotide as set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364.

Yet another aspect of the present invention discloses a recombinant gene construct comprising a polynucleotide template having nucleotide sequence set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364, wherein the polynucleotide template is expressible in a host cell to produce an enzyme which degrade cellulose and/or hemicellulose. Preferably, the recombinant gene construct further comprises a promoter region operably-linked to enhance expression of the polynucleotide template.

In accordance with one of the preferred embodiments of the present invention, the fungi of *M. phaseolina* is strain ms6. The isolated polypeptide is also preferably derived from this strain.

Still another aspect of the present invention is to provide a potentially commercial and feasible way to isolate cellulose and/or hemicelluloses degrading enzyme from *M. phaseolina* in order to keep up with the increasing global demand to digest cellulose and/or hemicelluloses from any source, including all biological sources, such as plant biomasses, woods or wood processing byproducts, in textile manufacture and in household and industrial cleaning agents, and/or in biomass waste processing for the production of fermentable sugar.

Further aspect of the invention is directed to utilization of the conversion of cellulosic and/or hemicellulosic substrates to fermentable sugars and the successive production of fuel alcohol.

Any or all of these utilities are capable of being developed into a kit for commercialization either as research products or as supplies for industrial uses. The kits may comprise polynucleotides and/or polypeptides corresponding to one or more *M. phaseolina* genes of the invention, antibodies, and/or other reagents.

One skilled in the art will readily appreciate that the present invention is well adapted to carry out the objects and obtain the ends and advantages mentioned, as well as those inherent therein. The embodiments described herein are not intended as limitations on the scope of the invention.

These and other features, aspects, and advantages of the present invention will become better understood with reference to the following description and claims.

BRIEF DESCRIPTION OF THE DRAWINGS AND TABLES

The accompanying drawings, which are incorporated in and form a part of the specification, illustrate the embodiments of the present invention and together with the description, serve to explain the principles of the invention.

FIG. 1 Displays molecular structure of cellulose.

FIG. 2 Displays conversion of cellulose to glucose using enzymatic digestion.

FIG. 3 is the electrophoresed agarose gel image showing the PCR amplification result in which lane 1 is polynucleotides of β-1,4-endoglucanase of SEQ ID NO. 1 and lane M is DNA molecular weight ladder.

FIG. 4 is the electrophoresed agarose gel image showing the PCR amplification result in which lane 1 is polynucleotides of β-1,4-endoglucanase of SEQ ID NO. 4 and lane M is DNA molecular weight ladder.

FIG. 5 is the electrophoresed agarose gel image showing the PCR amplification result in which lane 1 is polynucleotides of β-1,4-endoglucanase of SEQ ID NO. 7 and lane M is DNA molecular weight ladder.

FIG. 6 is the electrophoresed agarose gel image showing the PCR amplification result in which lane 1 is polynucleotides of β-1,4-endoglucanase of SEQ ID NO. 10 and lane M is DNA molecular weight ladder.

FIG. 7 is the electrophoresed agarose gel image showing the PCR amplification result in which lane 1 is polynucleotides of β-1,4-endoglucanase of SEQ ID NO. 13 and lane M is DNA molecular weight ladder.

FIG. 8 is the electrophoresed agarose gel image showing the PCR amplification result in which lane 1 is polynucleotides of β-1,4-endoglucanase of SEQ ID NO. 16 and lane M is DNA molecular weight ladder.

FIG. 9 is the electrophoresed agarose gel image showing the PCR amplification result in which lane 1 is polynucleotides of β-1,4-endoglucanase of SEQ ID NO. 19 and lane M is DNA molecular weight ladder.

FIG. 10 is the electrophoresed agarose gel image showing the PCR amplification result in which lane 1 is polynucleotides of β-1,4-endoglucanase of SEQ ID NO. 22 and lane M is DNA molecular weight ladder.

FIG. 11 is the electrophoresed agarose gel image showing the PCR amplification result in which lane 1 is polynucleotides of β-1,4-endoglucanase of SEQ ID NO. 25 and lane M is DNA molecular weight ladder.

FIG. 12 is the electrophoresed agarose gel image showing the PCR amplification result in which lane 1 is polynucleotides of β-1,4-endoglucanase of SEQ ID NO. 28 and lane M is DNA molecular weight ladder.

FIG. 13 is the electrophoresed agarose gel image showing the PCR amplification result in which lane 1 is polynucleotides of β-1,4-endoglucanase of SEQ ID NO. 31 and lane M is DNA molecular weight ladder.

FIG. 14 is the electrophoresed agarose gel image showing the PCR amplification result in which lane 1 is polynucleotides of β-1,4-endoglucanase of SEQ ID NO. 34 and lane M is DNA molecular weight ladder.

FIG. 15 is the electrophoresed agarose gel image showing the PCR amplification result in which lane 1 is polynucleotides of β-1,4-endoglucanase of SEQ ID NO. 37 and lane M is DNA molecular weight ladder.

FIG. 16 is the electrophoresed agarose gel image showing the PCR amplification result in which lane 1 is polynucleotides of β-1,4-endoglucanase of SEQ ID NO. 46 and lane M is DNA molecular weight ladder.

FIG. 17 is the electrophoresed agarose gel image showing the PCR amplification result in which lane 1 is polynucleotides of cellobiohydrolase of SEQ ID NO. 49 and lane M is DNA molecular weight ladder.

DETAILED DESCRIPTION OF THE INVENTION

Figure 1:
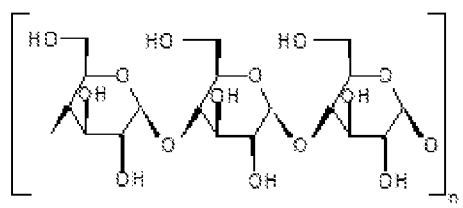
Figure 2:
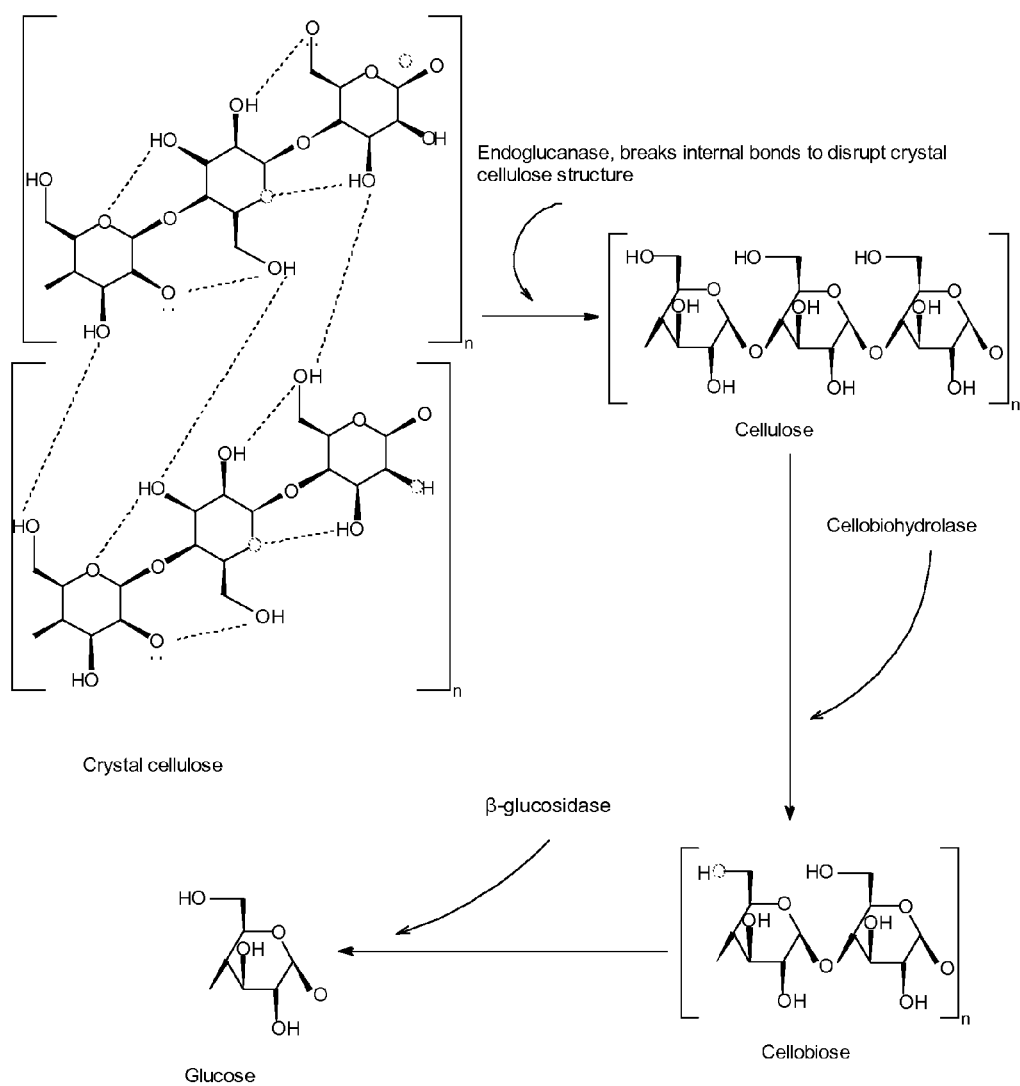
Figure 3:
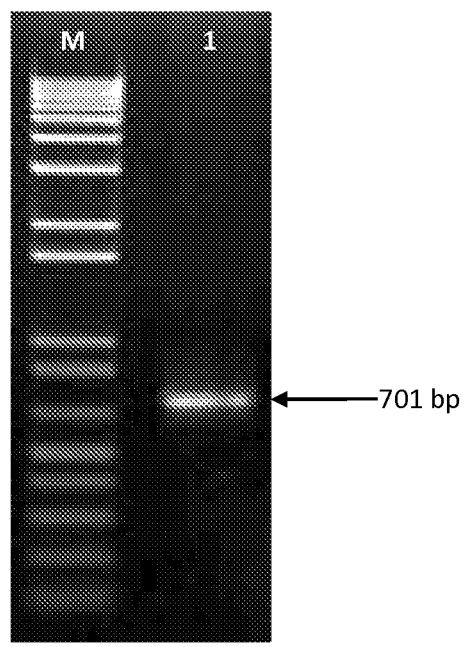
Figure 4:
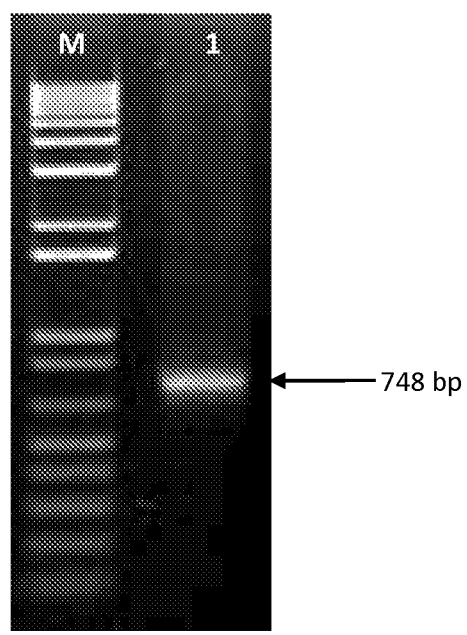
Figure 5:
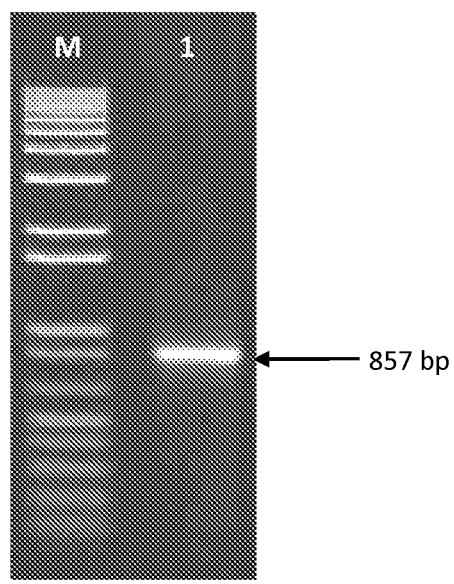
Figure 6:
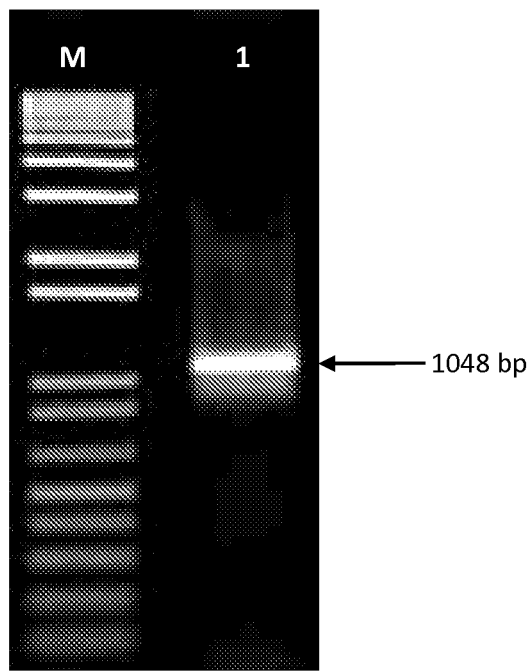
Figure 7:
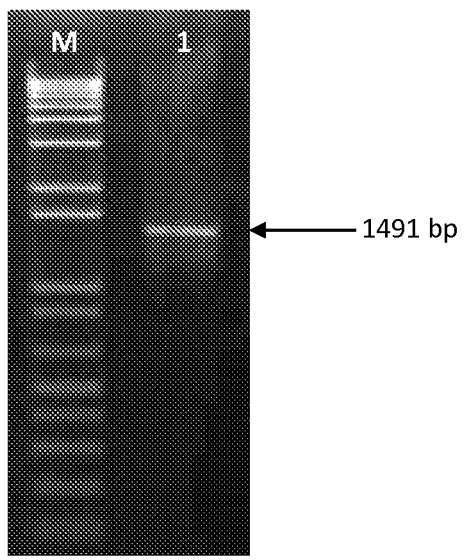
Figure 8:
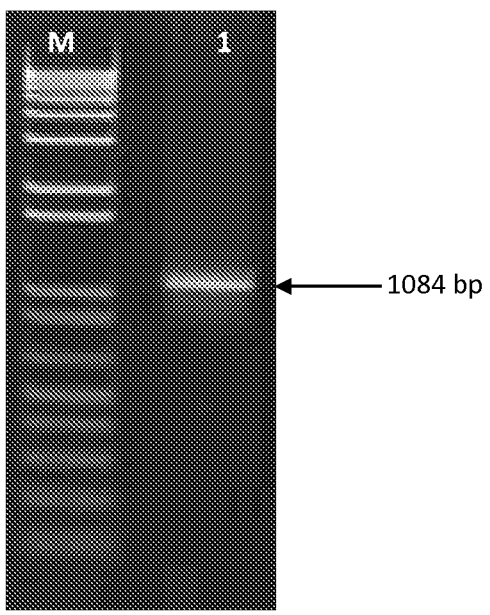
Figure 9:
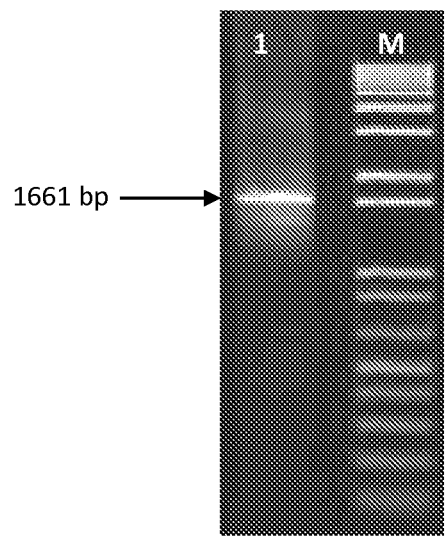
Figure 10:
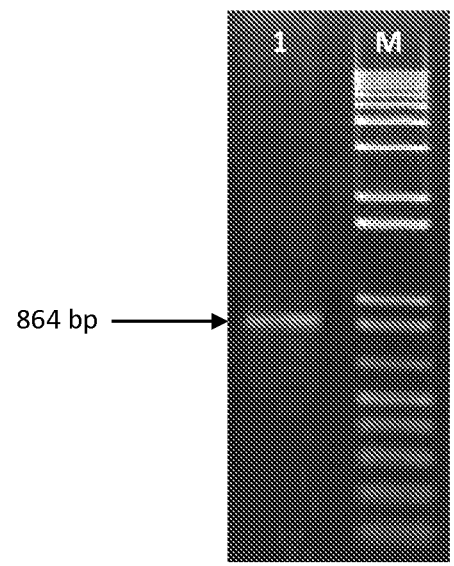
Figure 11:
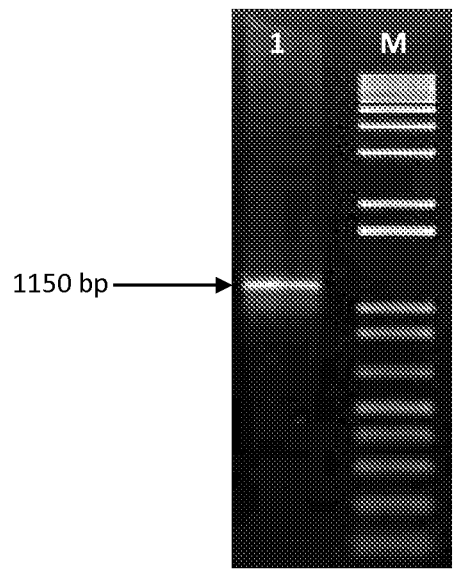
Figure 12:
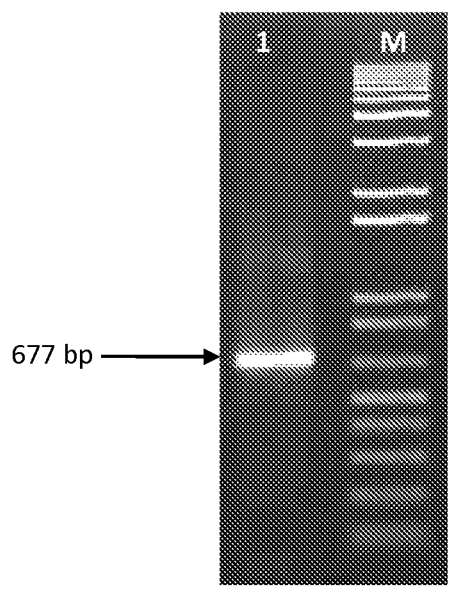
Figure 13:
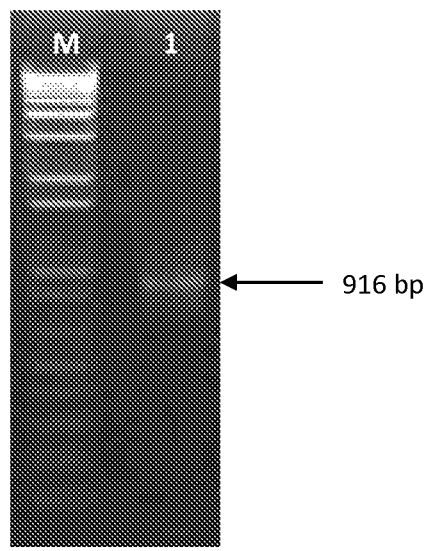
Figure 14:
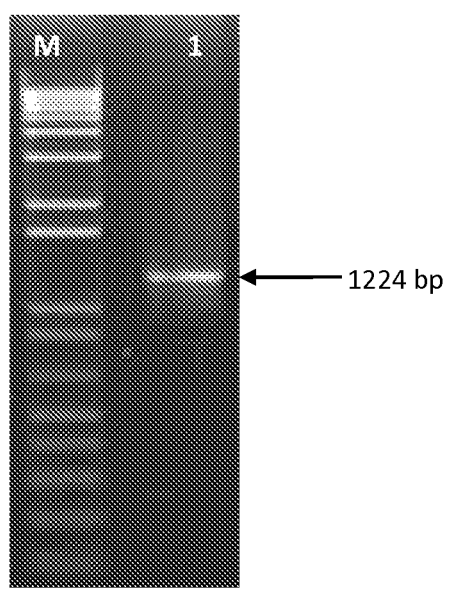
Figure 15:
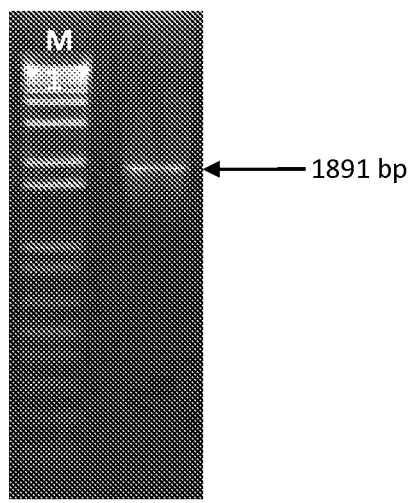
Figure 16:
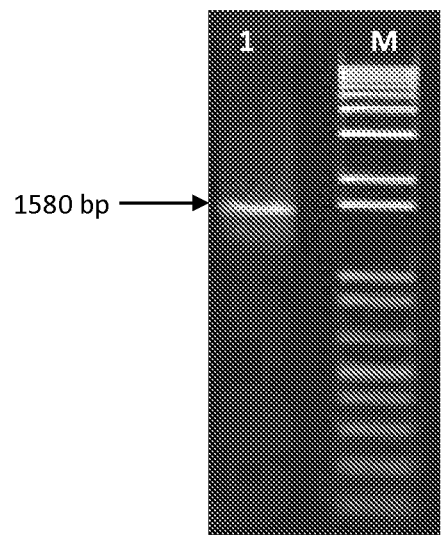
Figure 17:
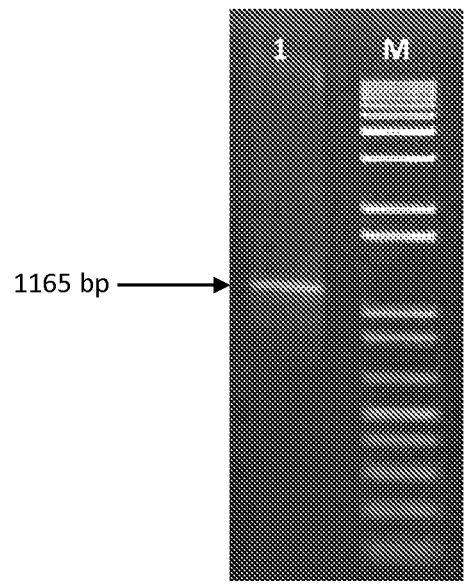
Figure 18:
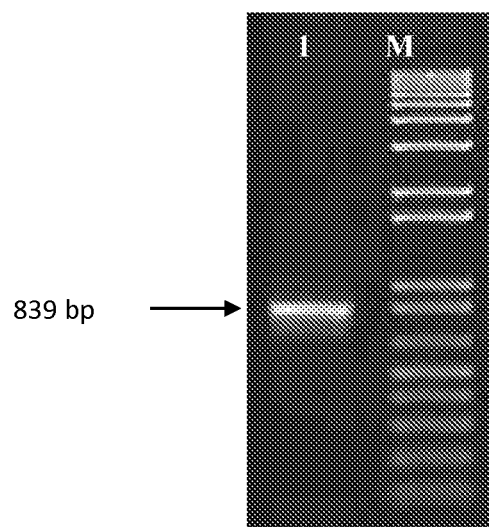
FIG. 18 is the electrophoresed agarose gel image showing the PCR amplification result in which lane 1 is polynucleotides of cellobiohydrolase of SEQ ID NO. 52 and lane M is DNA molecular weight ladder.
Figure 19:
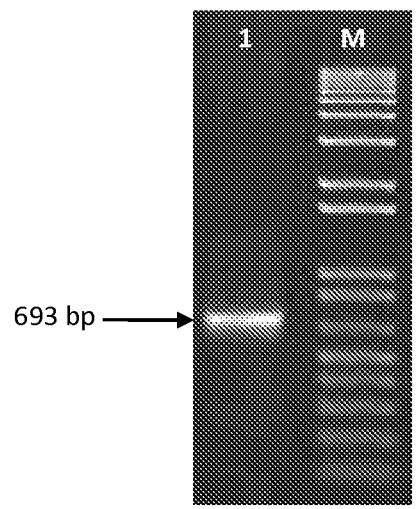
FIG. 19 is the electrophoresed agarose gel image showing the PCR amplification result in which lane 1 is polynucleotides of cellobiohydrolase of SEQ ID NO. 55 and lane M is DNA molecular weight ladder.
Figure 20:
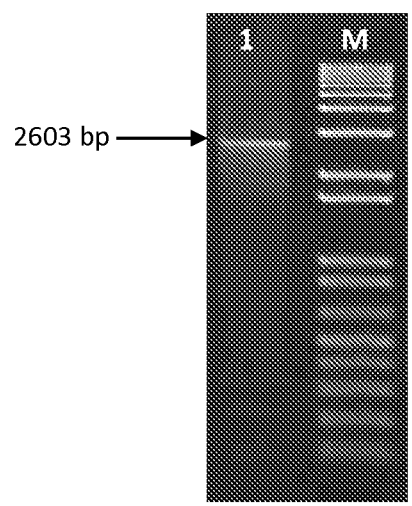
FIG. 20 is the electrophoresed agarose gel image showing the PCR amplification result in which lane 1 is polynucleotides of β-glucosidase of SEQ ID NO. 58 and lane M is DNA molecular weight ladder.
Figure 21:
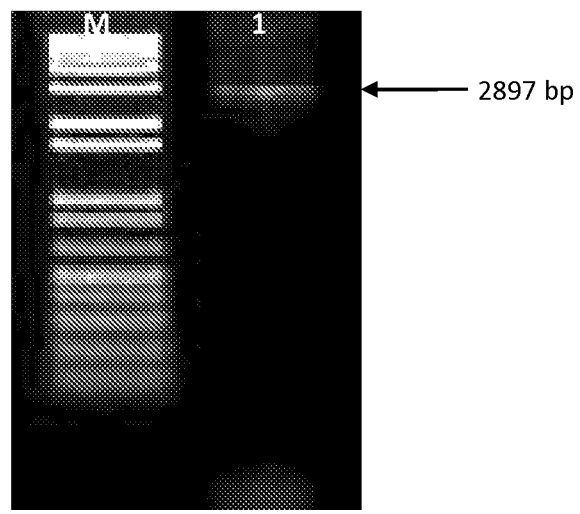
FIG. 21 is the electrophoresed agarose gel image showing the PCR amplification result in which lane 1 is polynucleotides of β-glucosidase of SEQ ID NO. 61 and lane M is DNA molecular weight ladder.
Figure 22:
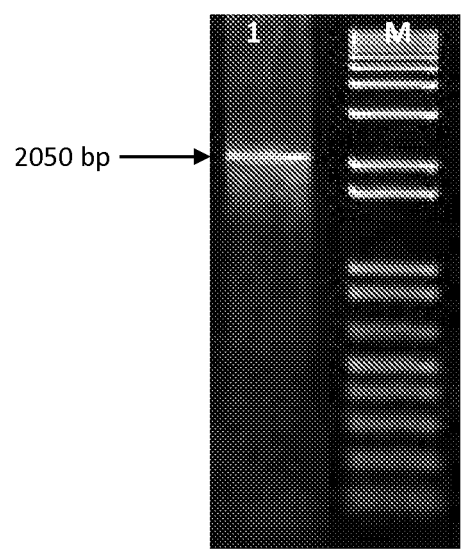
FIG. 22 is the electrophoresed agarose gel image showing the PCR amplification result in which lane 1 is polynucleotides of β-glucosidase of SEQ ID NO. 64 and lane M is DNA molecular weight ladder.
Figure 23:
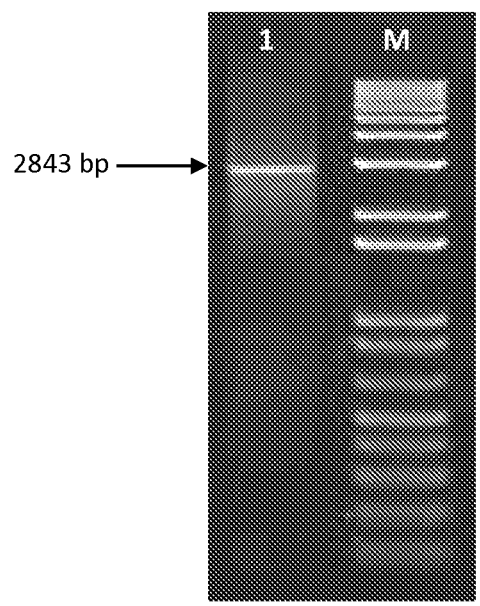
FIG. 23 is the electrophoresed agarose gel image showing the PCR amplification result in which lane 1 is polynucleotides of β-glucosidase of SEQ ID NO. 67 and lane M is DNA molecular weight ladder.
Figure 24:
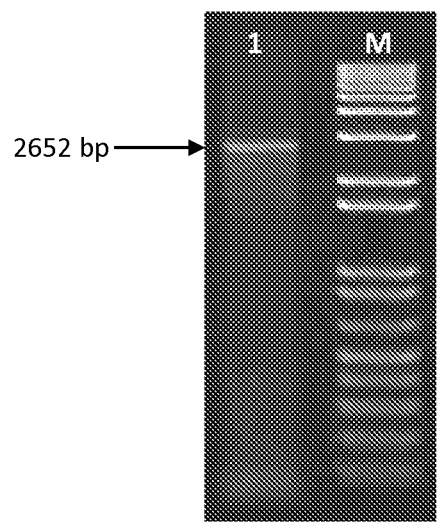
FIG. 24 is the electrophoresed agarose gel image showing the PCR amplification result in which lane 1 is polynucleotides of β-glucosidase of SEQ ID NO. 70 and lane M is DNA molecular weight ladder.
Figure 25:
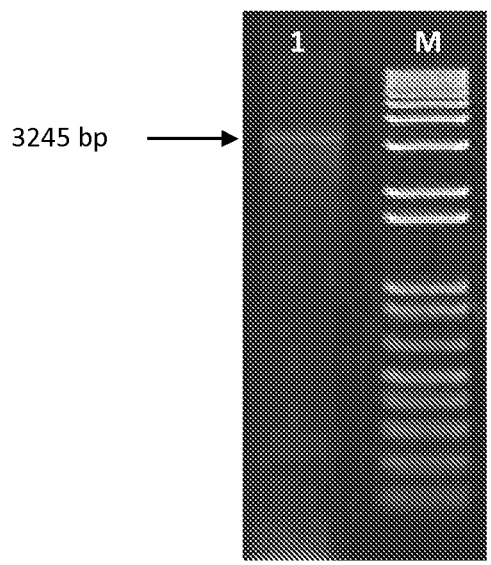
FIG. 25 is the electrophoresed agarose gel image showing the PCR amplification result in which lane 1 is polynucleotides of β-glucosidase of SEQ ID NO. 73 and lane M is DNA molecular weight ladder.
Figure 26:
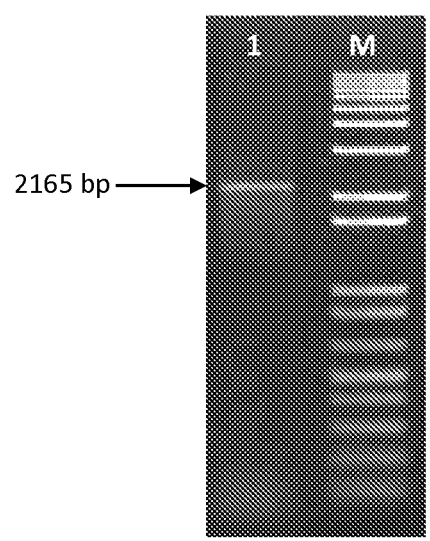
FIG. 26 is the electrophoresed agarose gel image showing the PCR amplification result in which lane 1 is polynucleotides of β-glucosidase of SEQ ID NO. 76 and lane M is DNA molecular weight ladder.
Figure 27:
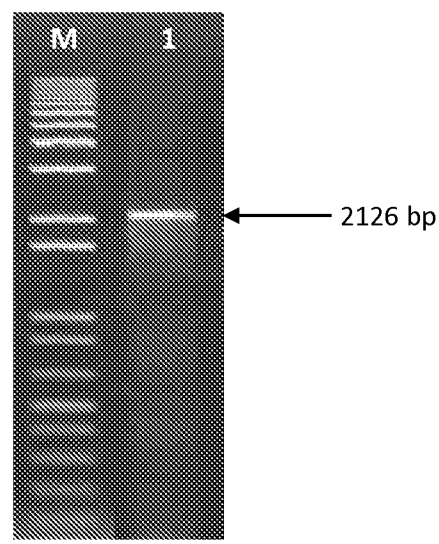
FIG. 27 is the electrophoresed agarose gel image showing the PCR amplification result in which lane 1 is polynucleotides of β-glucosidase of SEQ ID NO. 79 and lane M is DNA molecular weight ladder.
Figure 28:
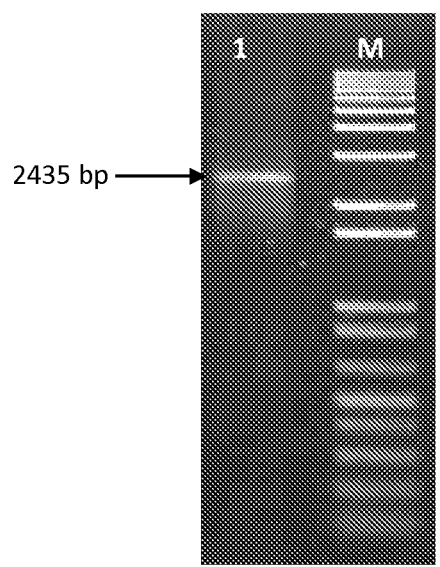
FIG. 28 is the electrophoresed agarose gel image showing the PCR amplification result in which lane 1 is polynucleotides of β-glucosidase of SEQ ID NO. 82 and lane M is DNA molecular weight ladder.
Figure 29:
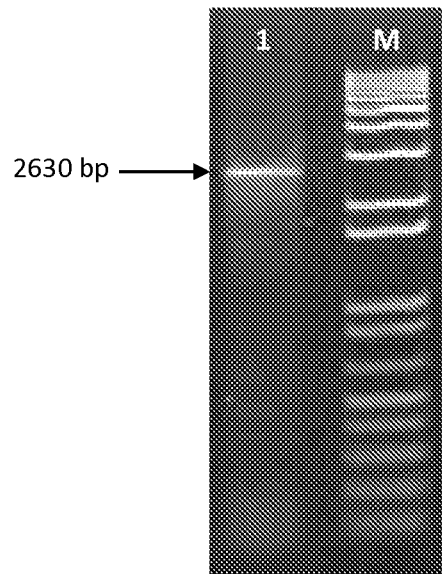
FIG. 29 is the electrophoresed agarose gel image showing the PCR amplification result in which lane 1 is polynucleotides of β-glucosidase of SEQ ID NO. 85 and lane M is DNA molecular weight ladder.
Figure 30:
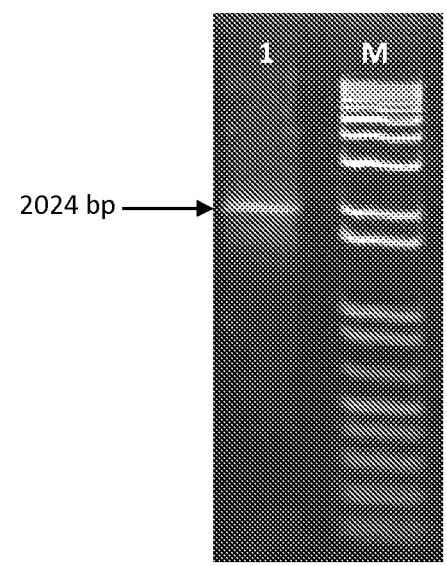
FIG. 30 is the electrophoresed agarose gel image showing the PCR amplification result in which lane 1 is polynucleotides of β-glucosidase of SEQ ID NO. 91 and lane M is DNA molecular weight ladder.
Figure 31:
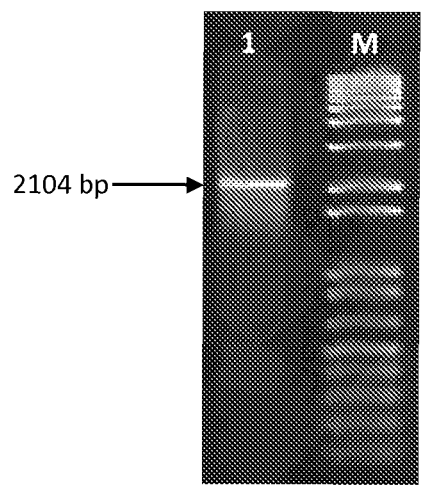
FIG. 31 is the electrophoresed agarose gel image showing the PCR amplification result in which lane 1 is polynucleotides of β-glucosidase of SEQ ID NO. 94 and lane M is DNA molecular weight ladder.
Figure 32:
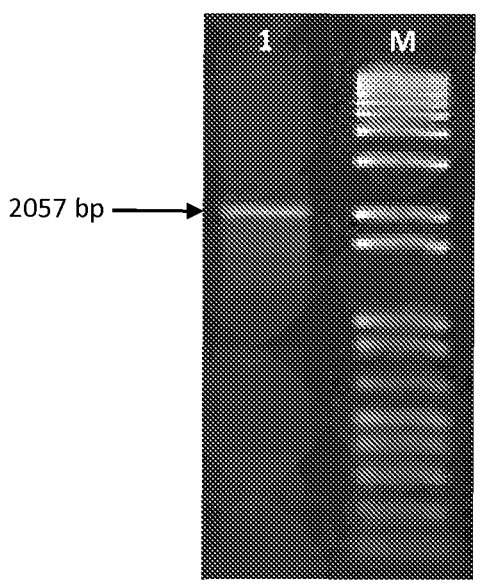
FIG. 32 is the electrophoresed agarose gel image showing the PCR amplification result in which lane 1 is polynucleotides of β-glucosidase of SEQ ID NO. 97 and lane M is DNA molecular weight ladder.
Figure 33:
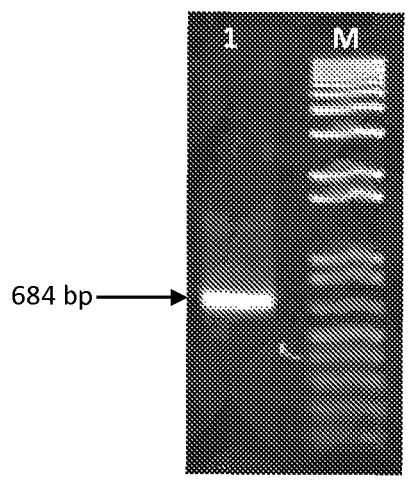
FIG. 33 is the electrophoresed agarose gel image showing the PCR amplification result in which lane 1 is polynucleotides of β-glucosidase of SEQ ID NO. 100 and lane M is DNA molecular weight ladder.
Figure 34:
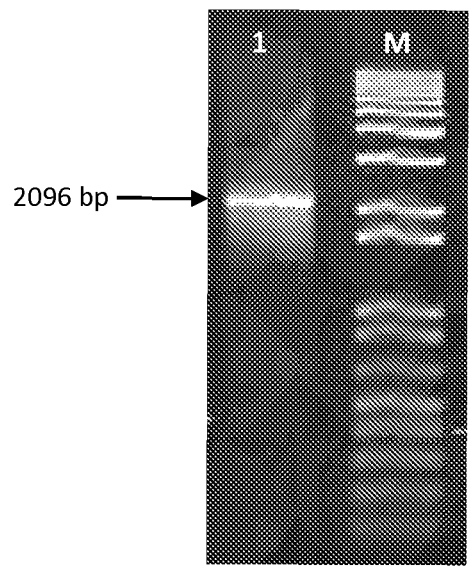
FIG. 34 is the electrophoresed agarose gel image showing the PCR amplification result in which lane 1 is polynucleotides of β-glucosidase of SEQ ID NO. 103 and lane M is DNA molecular weight ladder.
Figure 35:
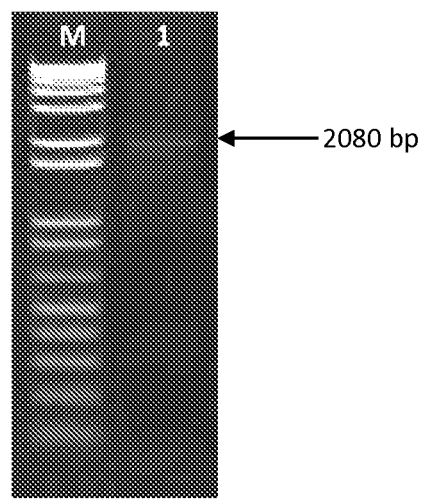
FIG. 35 is the electrophoresed agarose gel image showing the PCR amplification result in which lane 1 is polynucleotides of β-glucosidase of SEQ ID NO. 106 and lane M is DNA molecular weight ladder.
Figure 36:
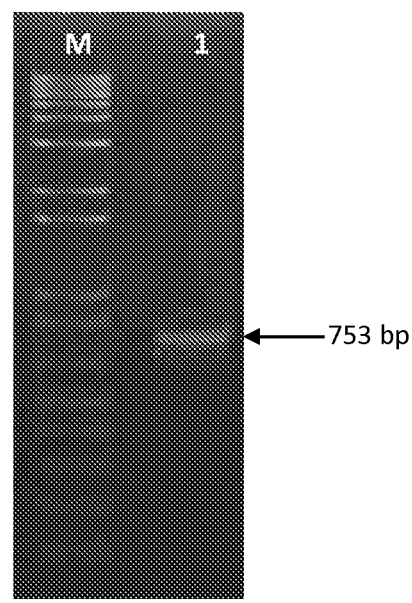
FIG. 36 is the electrophoresed agarose gel image showing the PCR amplification result in which lane 1 is polynucleotides of β-glucosidase of SEQ ID NO. 109 and lane M is DNA molecular weight ladder.
Figure 37:
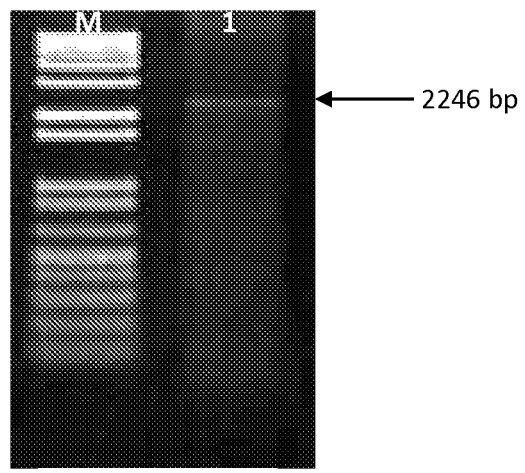
FIG. 37 is the electrophoresed agarose gel image showing the PCR amplification result in which lane 1 is polynucleotides of β-glucosidase of SEQ ID NO. 112 and lane M is DNA molecular weight ladder.
Figure 38:
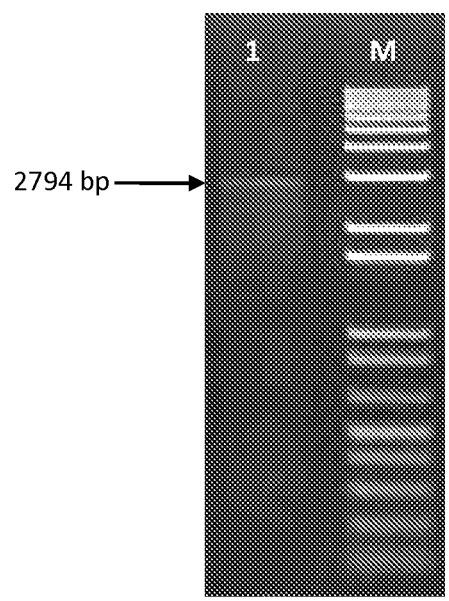
FIG. 38 is the electrophoresed agarose gel image showing the PCR amplification result in which lane 1 is polynucleotides of β-glucosidase of SEQ ID NO. 115 and lane M is DNA molecular weight ladder.
Figure 39:
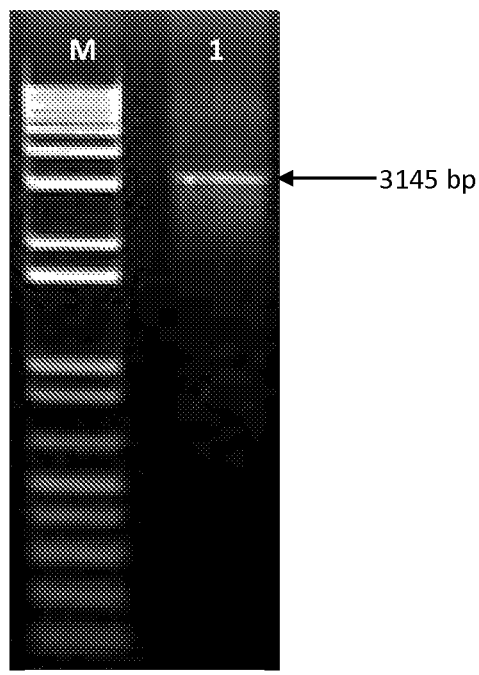
FIG. 39 is the electrophoresed agarose gel image showing the PCR amplification result in which lane 1 is polynucleotides of α-glucosidase of SEQ ID NO. 118 and lane M is DNA molecular weight ladder.
Figure 40:
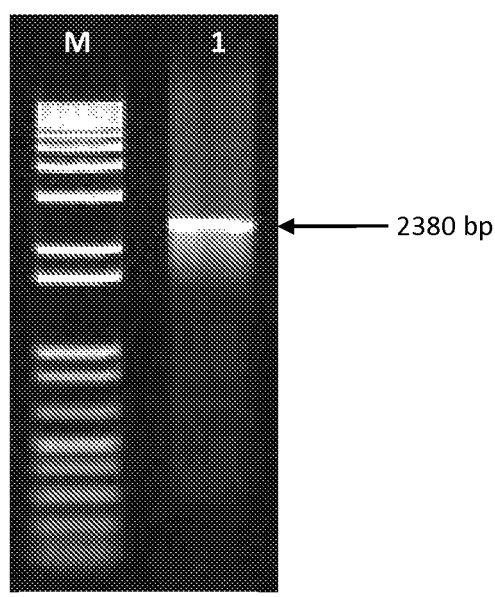
FIG. 40 is the electrophoresed agarose gel image showing the PCR amplification result in which lane 1 is polynucleotides of α-glucosidase of SEQ ID NO. 121 and lane M is DNA molecular weight ladder.
Figure 41:
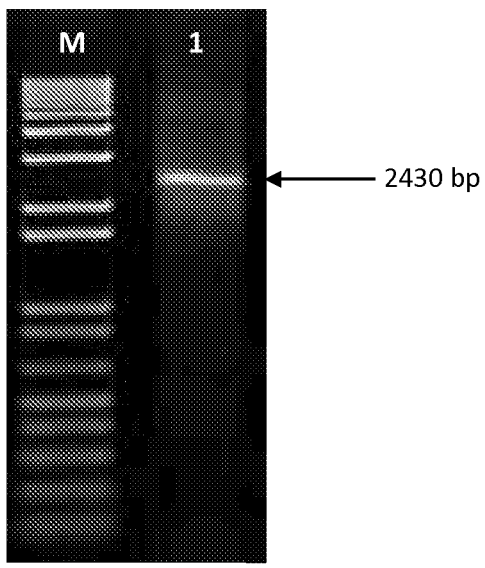
FIG. 41 is the electrophoresed agarose gel image showing the PCR amplification result in which lane 1 is polynucleotides of α-glucosidase of SEQ ID NO. 124 and lane M is DNA molecular weight ladder.
Figure 42:
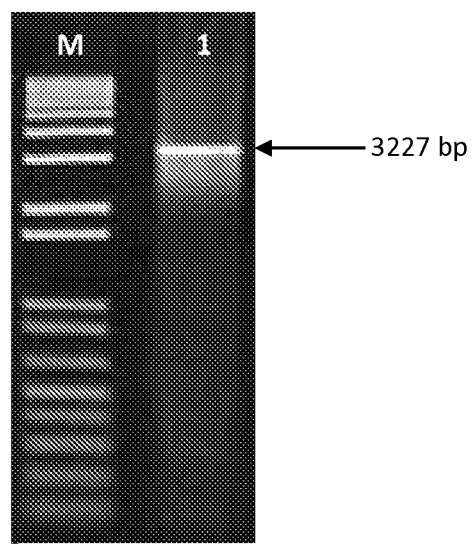
FIG. 42 is the electrophoresed agarose gel image showing the PCR amplification result in which lane 1 is polynucleotides of α-glucosidase of SEQ ID NO. 127 and lane M is DNA molecular weight ladder.
Figure 43:
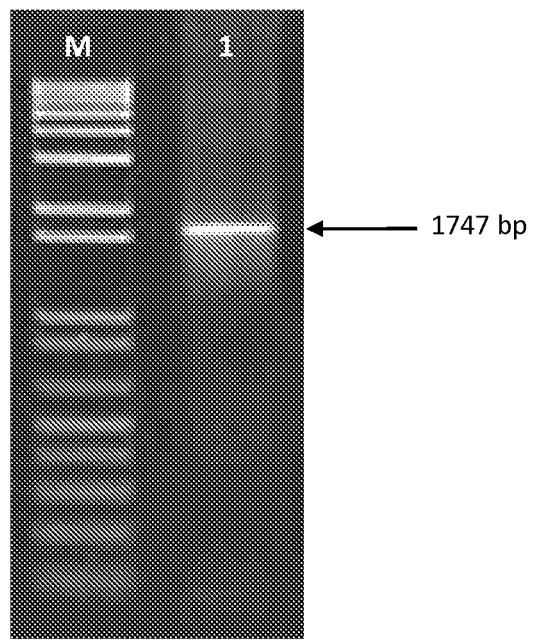
FIG. 43 is the electrophoresed agarose gel image showing the PCR amplification result in which lane 1 is polynucleotides of α-glucosidase of SEQ ID NO. 133 and lane M is DNA molecular weight ladder.
Figure 44:
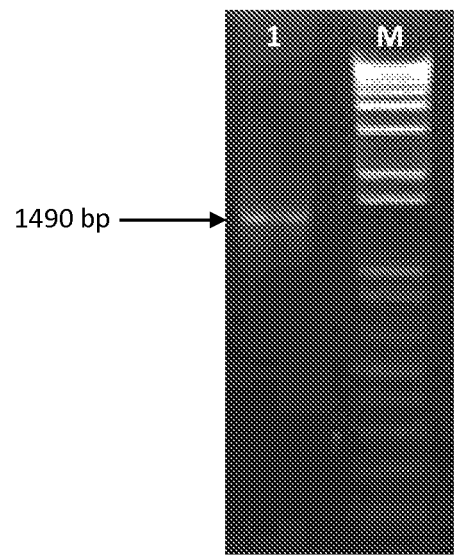
FIG. 44 is the electrophoresed agarose gel image showing the PCR amplification result in which lane 1 is polynucleotides of α-glucosidase of SEQ ID NO. 136 and lane M is DNA molecular weight ladder.
Figure 45:
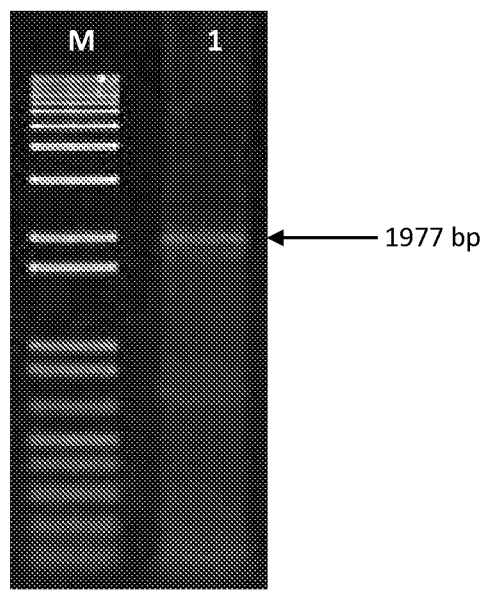
FIG. 45 is the electrophoresed agarose gel image showing the PCR amplification result in which lane 1 is polynucleotides of exo-1,3-β-glucanase of SEQ ID NO. 139 and lane M is DNA molecular weight ladder.
Figure 46:
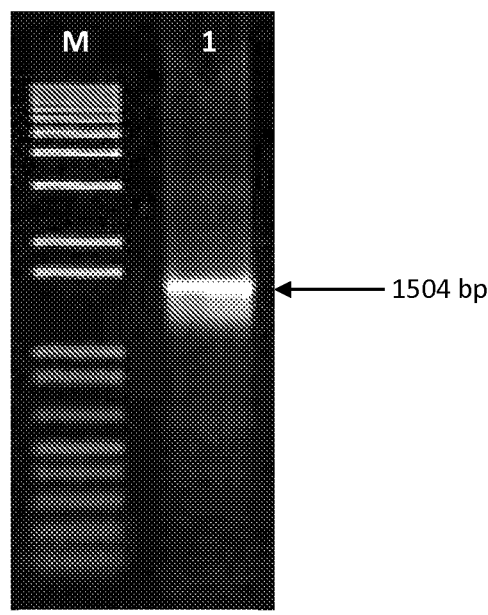
FIG. 46 is the electrophoresed agarose gel image showing the PCR amplification result in which lane 1 is polynucleotides of exo-1,3-β-glucanase of SEQ ID NO. 142 and lane M is DNA molecular weight ladder.
Figure 47:
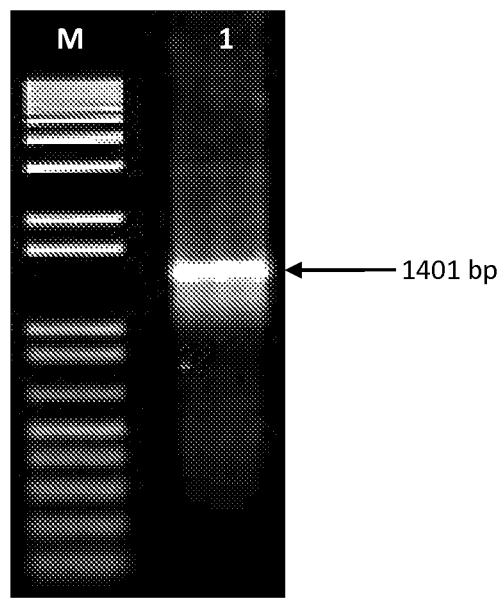
FIG. 47 is the electrophoresed agarose gel image showing the PCR amplification result in which lane 1 is polynucleotides of exo-1,3-β-glucanase of SEQ ID NO. 145 and lane M is DNA molecular weight ladder.
Figure 48:
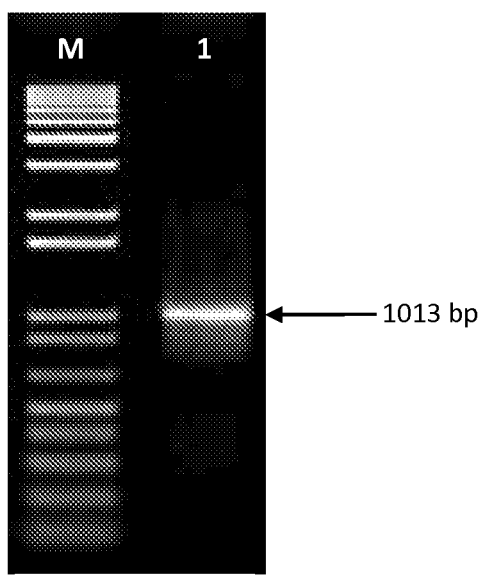
FIG. 48 is the electrophoresed agarose gel image showing the PCR amplification result in which lane 1 is polynucleotides of exo-1,3-β-glucanase of SEQ ID NO. 148 and lane M is DNA molecular weight ladder.
Figure 49:
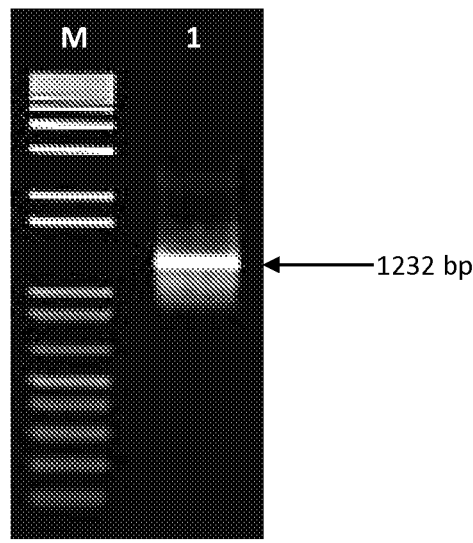
FIG. 49 is the electrophoresed agarose gel image showing the PCR amplification result in which lane 1 is polynucleotides of exo-1,3-β-glucanase of SEQ ID NO. 151 and lane M is DNA molecular weight ladder.
Figure 50:
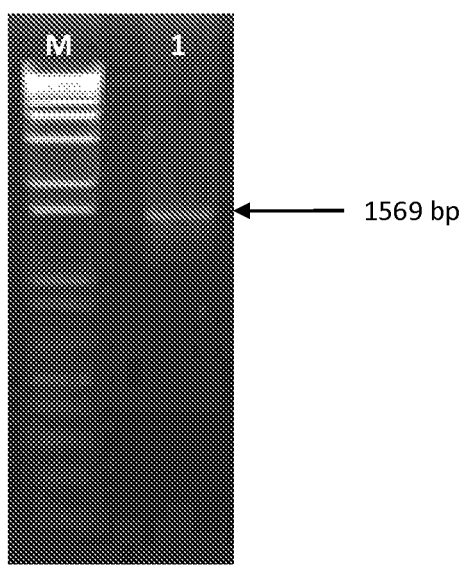
FIG. 50 is the electrophoresed agarose gel image showing the PCR amplification result in which lane 1 is polynucleotides of exo-1,3-β-glucanase of SEQ ID NO. 154 and lane M is DNA molecular weight ladder.
Figure 51:
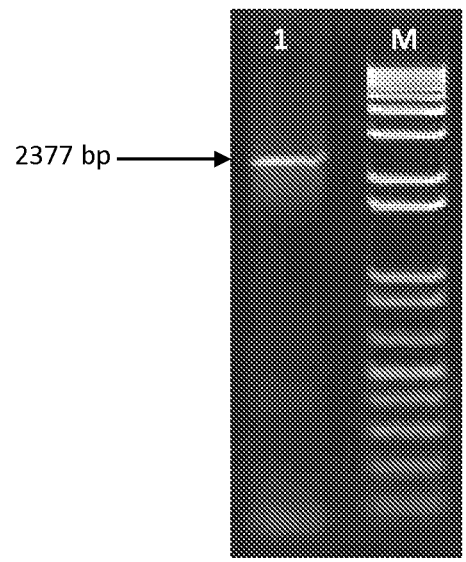
FIG. 51 is the electrophoresed agarose gel image showing the PCR amplification result in which lane 1 is polynucleotides of exo-1,3-β-glucanase of SEQ ID NO. 157 and lane M is DNA molecular weight ladder.
Figure 52:
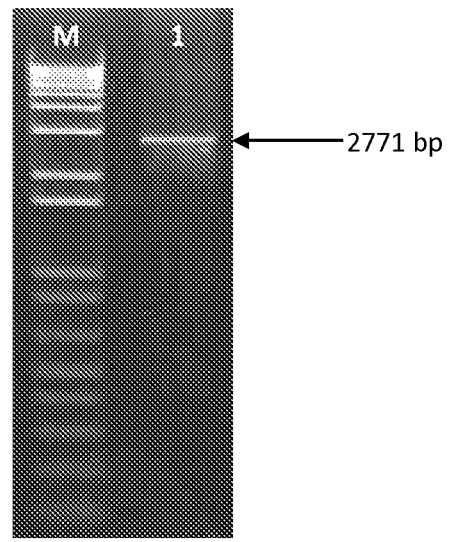
FIG. 52 is the electrophoresed agarose gel image showing the PCR amplification result in which lane 1 is polynucleotides of exo-1,3-β-glucanase of SEQ ID NO. 160 and lane M is DNA molecular weight ladder.
Figure 53:
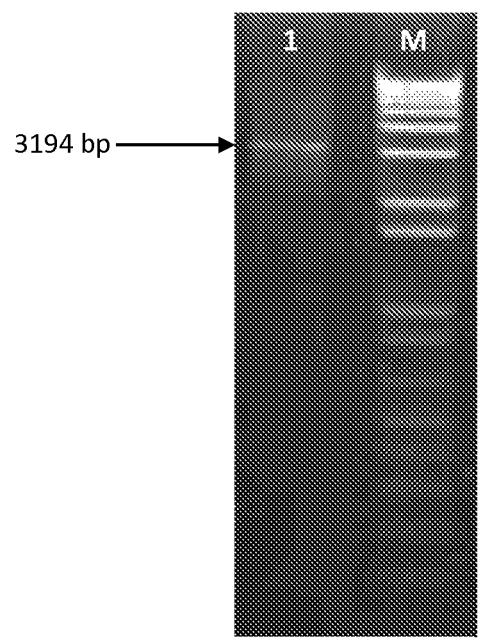
FIG. 53 is the electrophoresed agarose gel image showing the PCR amplification result in which lane 1 is polynucleotides of exo-1,3-β-glucanase of SEQ ID NO. 163 and lane M is DNA molecular weight ladder.
Figure 54:
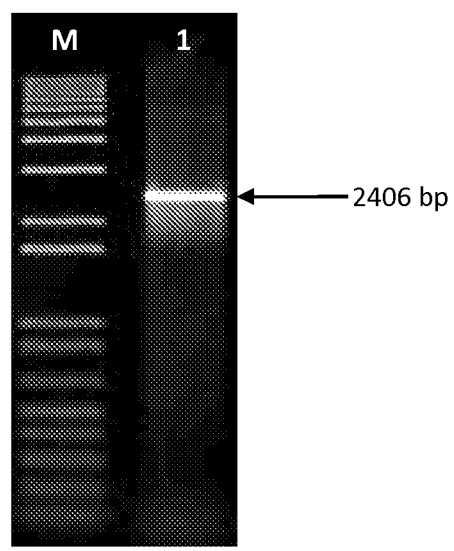
FIG. 54 is the electrophoresed agarose gel image showing the PCR amplification result in which lane 1 is polynucleotides of α-glucan lyase of SEQ ID NO. 166 and lane M is DNA molecular weight ladder.
Figure 55:
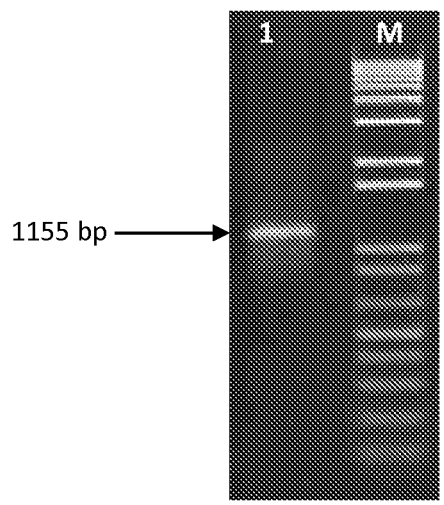
FIG. 55 is the electrophoresed agarose gel image showing the PCR amplification result in which lane 1 is polynucleotides of α-xylosidase of SEQ ID NO. 175 and lane M is DNA molecular weight ladder.
Figure 56:
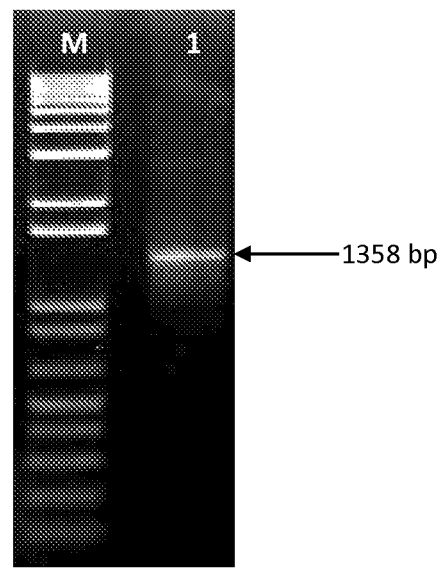
FIG. 56 is the electrophoresed agarose gel image showing the PCR amplification result in which lane 1 is polynucleotides of d-4,5-unsaturated b-glucuronyl hydrolase of SEQ ID NO. 178 and lane M is DNA molecular weight ladder.
Figure 57:
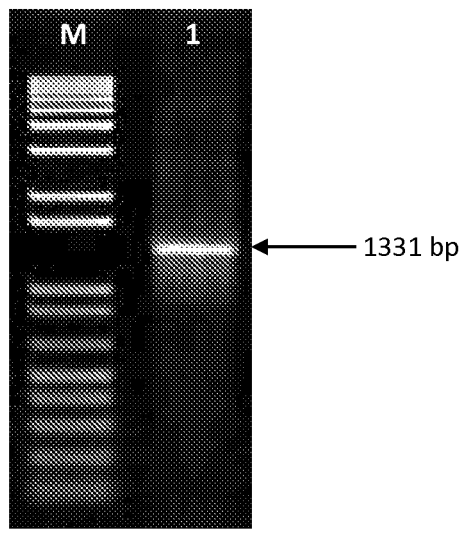
FIG. 57 is the electrophoresed agarose gel image showing the PCR amplification result in which lane 1 is polynucleotides of d-4,5-unsaturated b-glucuronyl hydrolase of SEQ ID NO. 181 and lane M is DNA molecular weight ladder.
Figure 58:
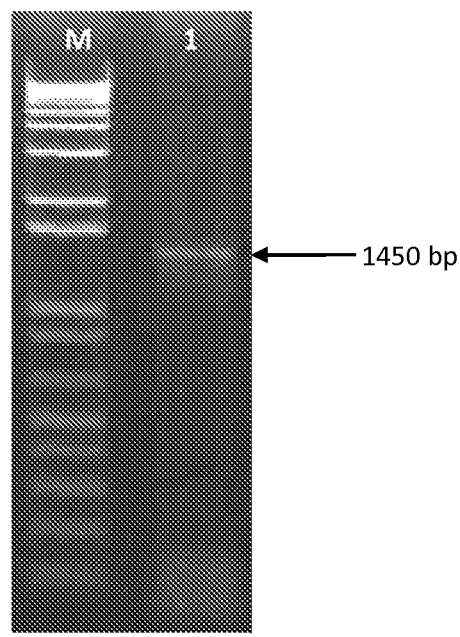
FIG. 58 is the electrophoresed agarose gel image showing the PCR amplification result in which lane 1 is polynucleotides of d-4,5-unsaturated b-glucuronyl hydrolase of SEQ ID NO. 184 and lane M is DNA molecular weight ladder.
Figure 59:
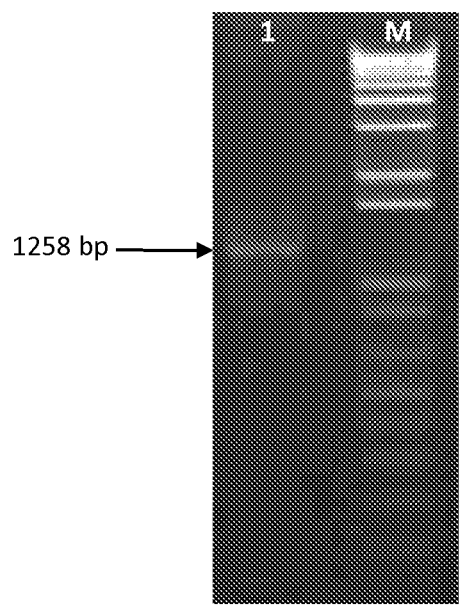
FIG. 59 is the electrophoresed agarose gel image showing the PCR amplification result in which lane 1 is polynucleotides of d-4,5-unsaturated b-glucuronyl hydrolase of SEQ ID NO. 187 and lane M is DNA molecular weight ladder.
Figure 60:
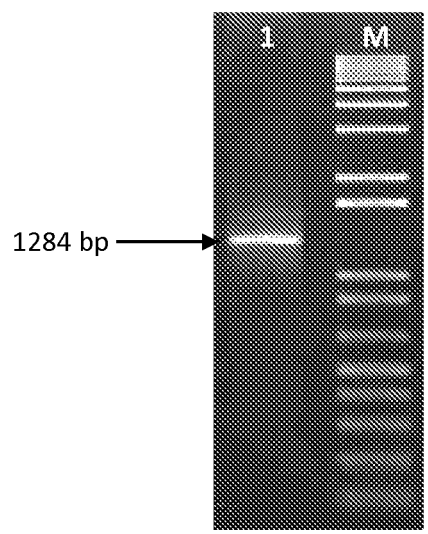
FIG. 60 is the electrophoresed agarose gel image showing the PCR amplification result in which lane 1 is polynucleotides of d-4,5-unsaturated b-glucuronyl hydrolase of SEQ ID NO. 190 and lane M is DNA molecular weight ladder.
Figure 61:
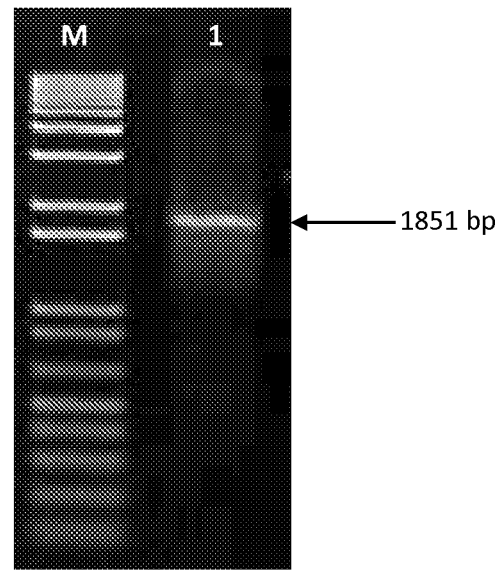
FIG. 61 is the electrophoresed agarose gel image showing the PCR amplification result in which lane 1 is polynucleotides of glucan 1,4-α-glucosidase of SEQ ID NO. 193 and lane M is DNA molecular weight ladder.
Figure 62:
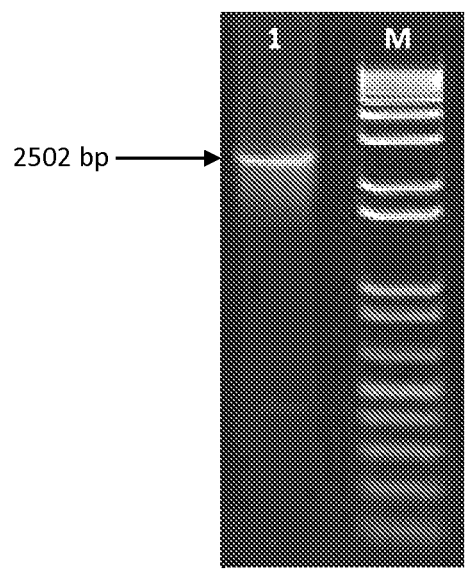
FIG. 62 is the electrophoresed agarose gel image showing the PCR amplification result in which lane 1 is polynucleotides of glucan 1,4-α-glucosidase of SEQ ID NO. 196 and lane M is DNA molecular weight ladder.
Figure 63:
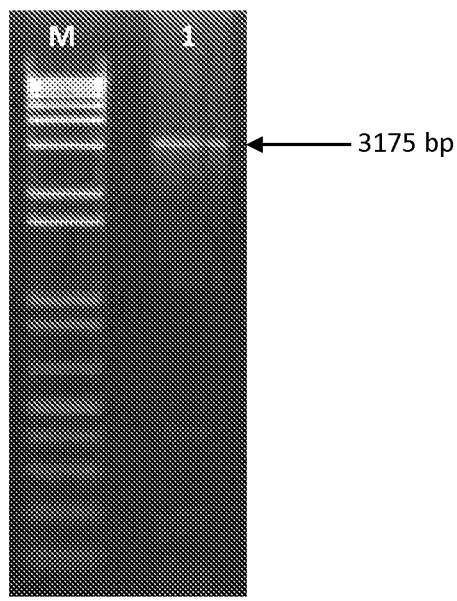
FIG. 63 is the electrophoresed agarose gel image showing the PCR amplification result in which lane 1 is polynucleotides of α-1,2-mannosidase of SEQ ID NO. 202 and lane M is DNA molecular weight ladder.
Figure 64:
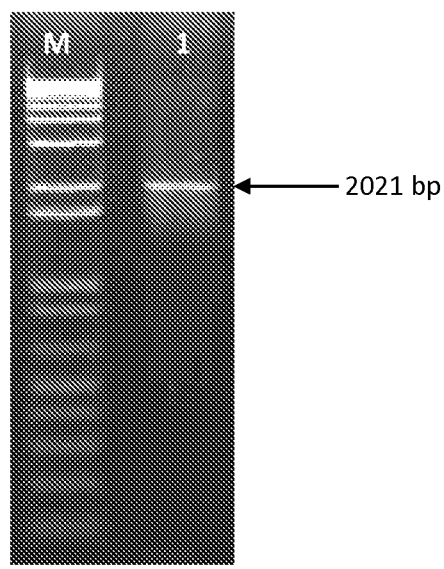
FIG. 64 is the electrophoresed agarose gel image showing the PCR amplification result in which lane 1 is polynucleotides of α-1,2-mannosidase of SEQ ID NO. 205 and lane M is DNA molecular weight ladder.
Figure 65:
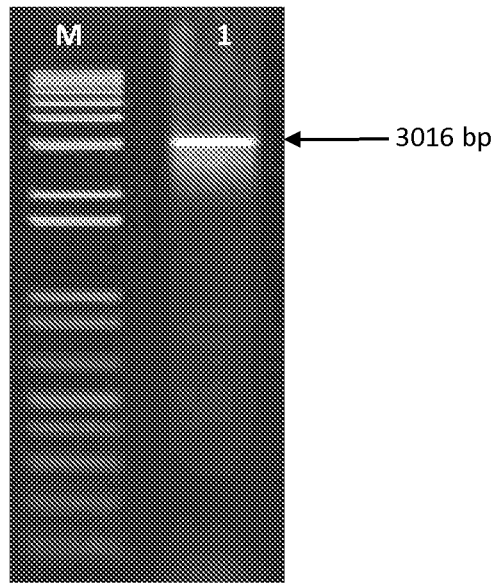
FIG. 65 is the electrophoresed agarose gel image showing the PCR amplification result in which lane 1 is polynucleotides of α-1,2-mannosidase of SEQ ID NO. 208 and lane M is DNA molecular weight ladder.
Figure 66:
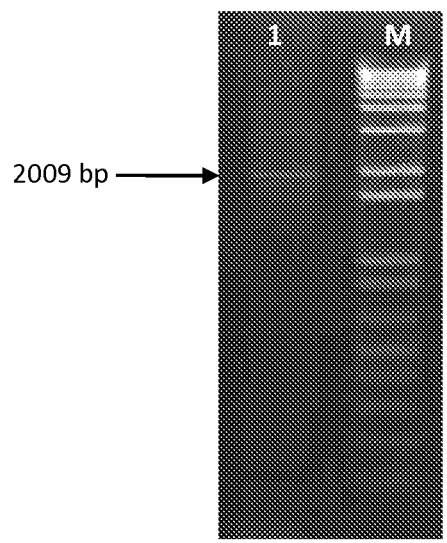
FIG. 66 is the electrophoresed agarose gel image showing the PCR amplification result in which lane 1 is polynucleotides of α-1,2-mannosidase of SEQ ID NO. 211 and lane M is DNA molecular weight ladder.
Figure 67:
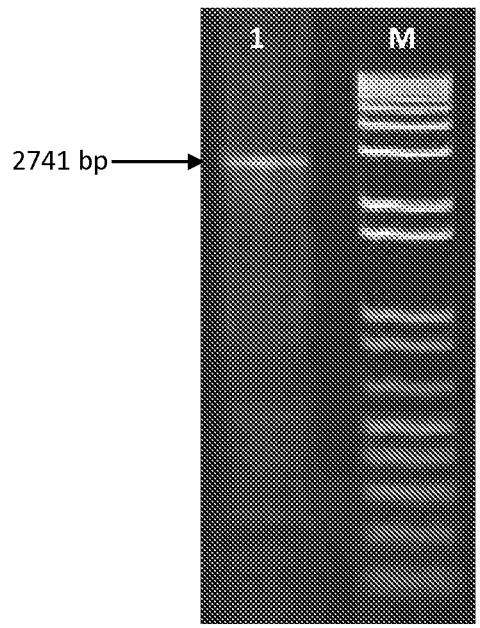
FIG. 67 is the electrophoresed agarose gel image showing the PCR amplification result in which lane 1 is polynucleotides of α-1,2-mannosidase of SEQ ID NO. 214 and lane M is DNA molecular weight ladder.
Figure 68:
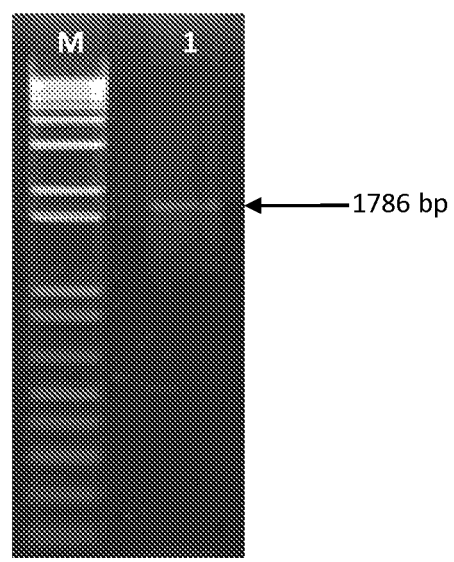
FIG. 68 is the electrophoresed agarose gel image showing the PCR amplification result in which lane 1 is polynucleotides of α-1,3-glucanase of SEQ ID NO. 220 and lane M is DNA molecular weight ladder.
Figure 69:
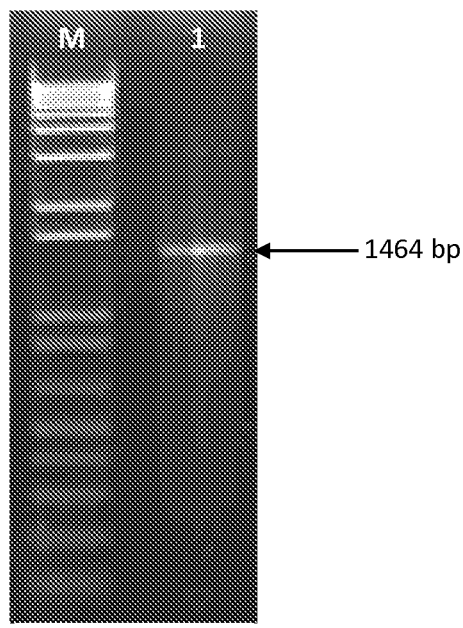
FIG. 69 is the electrophoresed agarose gel image showing the PCR amplification result in which lane 1 is polynucleotides of α-1,3-glucanase of SEQ ID NO. 223 and lane M is DNA molecular weight ladder.
Figure 70:
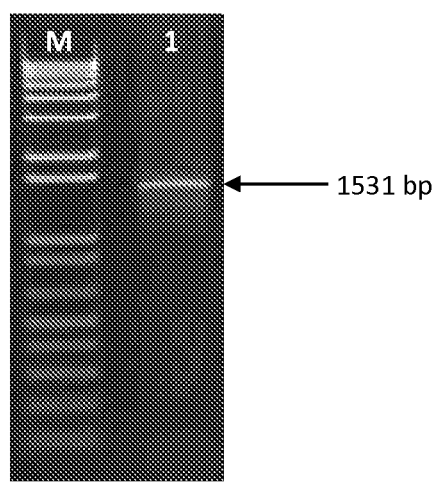
FIG. 70 is the electrophoresed agarose gel image showing the PCR amplification result in which lane 1 is polynucleotides of α-1,3-glucanase of SEQ ID NO. 226 and lane M is DNA molecular weight ladder.
Figure 71:
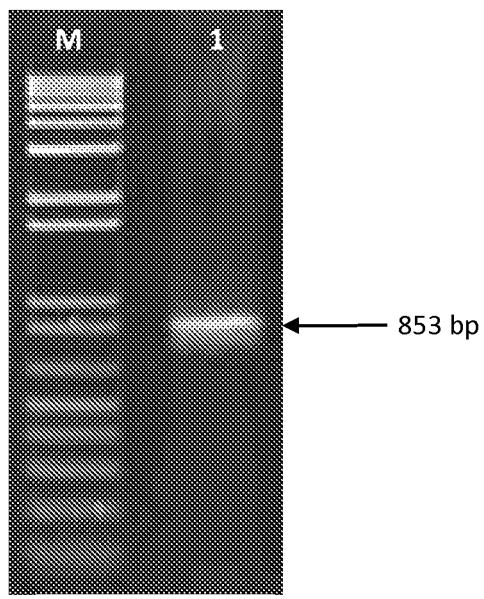
FIG. 71 is the electrophoresed agarose gel image showing the PCR amplification result in which lane 1 is polynucleotides of α-1,3-glucanase of SEQ ID NO. 229 and lane M is DNA molecular weight ladder.
Figure 72:
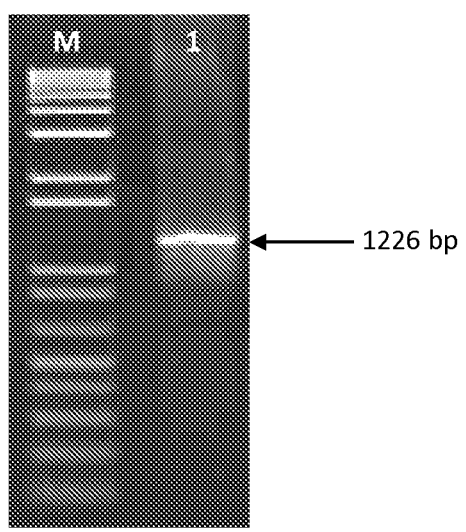
FIG. 72 is the electrophoresed agarose gel image showing the PCR amplification result in which lane 1 is polynucleotides of α-1,3-glucanase of SEQ ID NO. 232 and lane M is DNA molecular weight ladder.
Figure 73:
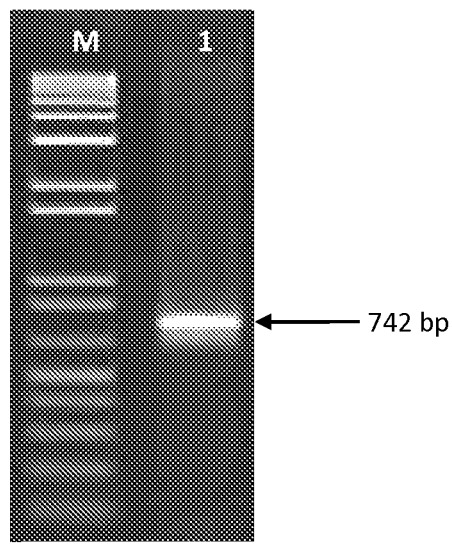
FIG. 73 is the electrophoresed agarose gel image showing the PCR amplification result in which lane 1 is polynucleotides of α-1,3-glucanase of SEQ ID NO. 235 and lane M is DNA molecular weight ladder.
Figure 74:
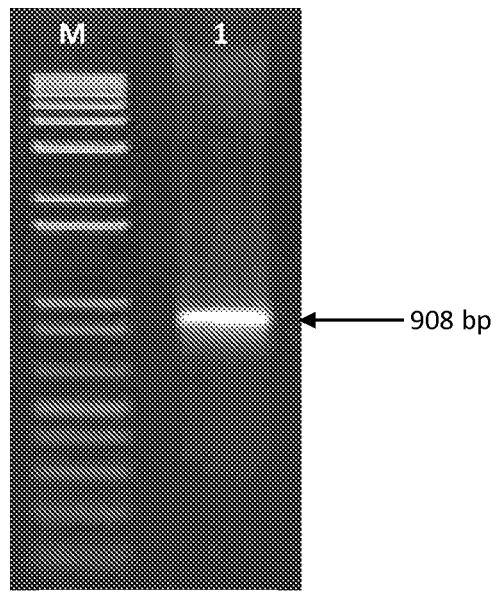
FIG. 74 is the electrophoresed agarose gel image showing the PCR amplification result in which lane 1 is polynucleotides of α-1,3-glucanase of SEQ ID NO. 238 and lane M is DNA molecular weight ladder.
Figure 75:
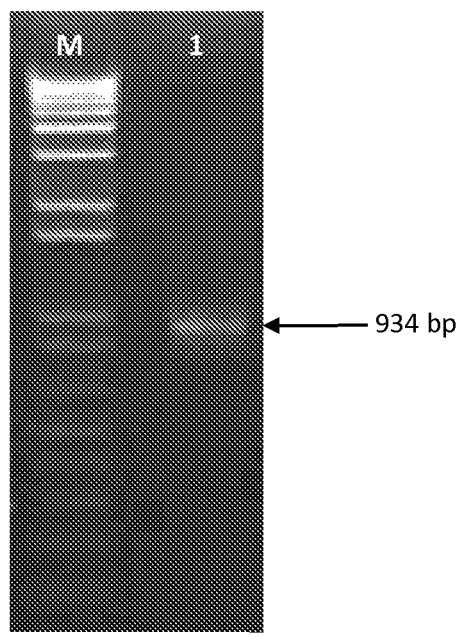
FIG. 75 is the electrophoresed agarose gel image showing the PCR amplification result in which lane 1 is polynucleotides of α-1,3-glucanase of SEQ ID NO. 241 and lane M is DNA molecular weight ladder.
Figure 76:
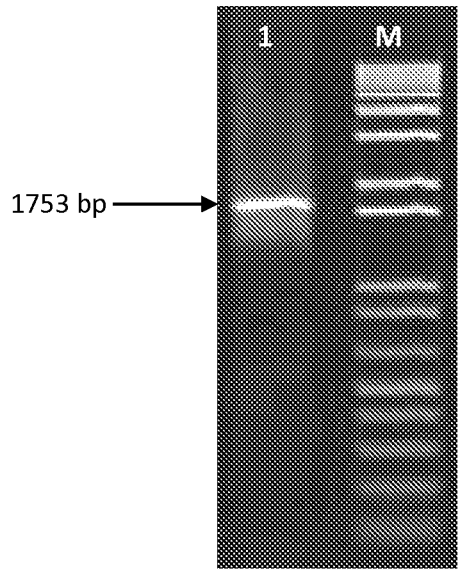
FIG. 76 is the electrophoresed agarose gel image showing the PCR amplification result in which lane 1 is polynucleotides of α-1,3-glucanase of SEQ ID NO. 247 and lane M is DNA molecular weight ladder.
Figure 77:
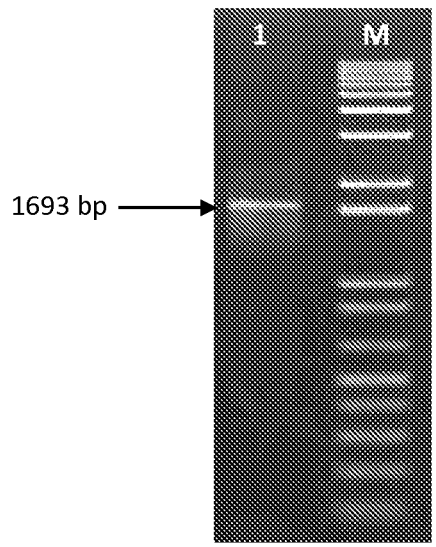
FIG. 77 is the electrophoresed agarose gel image showing the PCR amplification result in which lane 1 is polynucleotides of α-1,3-glucanase of SEQ ID NO. 250 and lane M is DNA molecular weight ladder.
Figure 78:
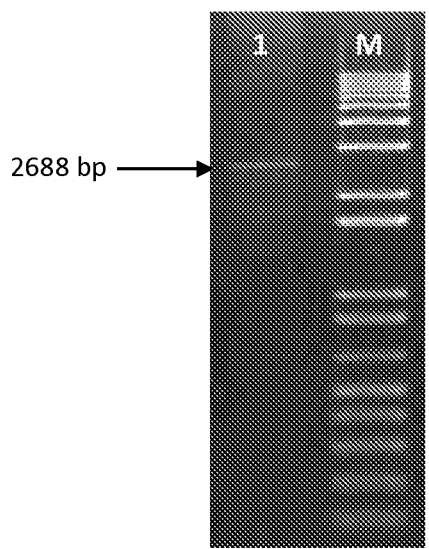
FIG. 78 is the electrophoresed agarose gel image showing the PCR amplification result in which lane 1 is polynucleotides of α-fucosidase of SEQ ID NO. 253 and lane M is DNA molecular weight ladder.
Figure 79:
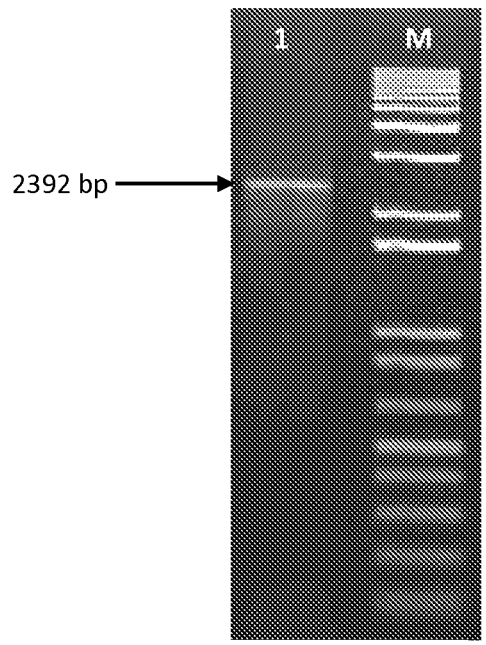
FIG. 79 is the electrophoresed agarose gel image showing the PCR amplification result in which lane 1 is polynucleotides of α-fucosidase of SEQ ID NO. 256 and lane M is DNA molecular weight ladder.
Figure 80:
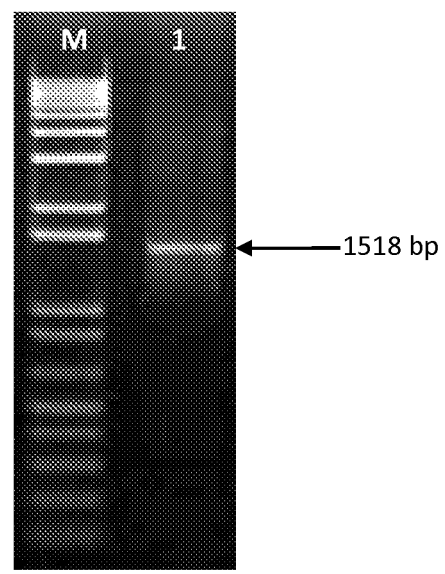
FIG. 80 is the electrophoresed agarose gel image showing the PCR amplification result in which lane 1 is polynucleotides of xylan β-1,4-xylosidase of SEQ ID NO. 259 and lane M is DNA molecular weight ladder.
Figure 81:
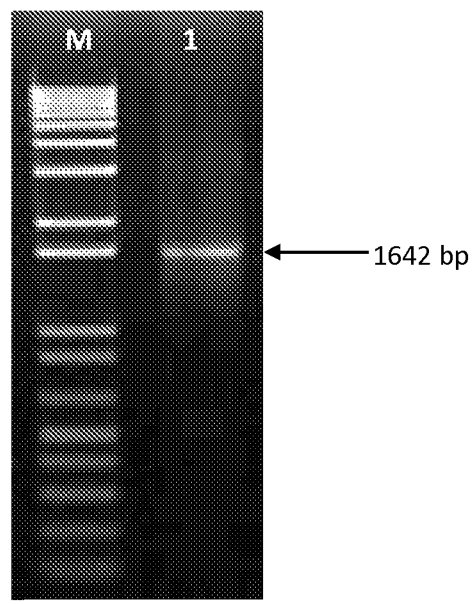
FIG. 81 is the electrophoresed agarose gel image showing the PCR amplification result in which lane 1 is polynucleotides of xylan β-1,4-xylosidase of SEQ ID NO. 265 and lane M is DNA molecular weight ladder.
Figure 82:
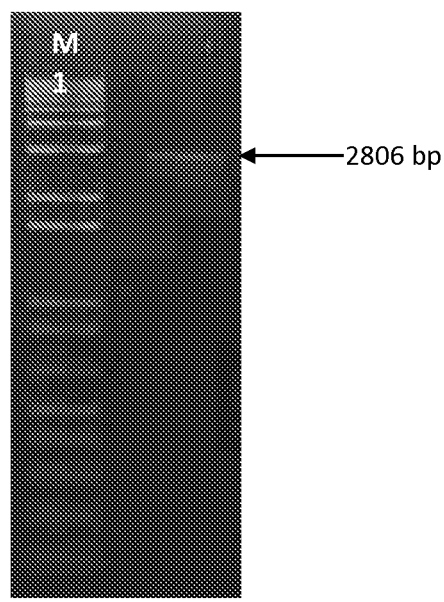
FIG. 82 is the electrophoresed agarose gel image showing the PCR amplification result in which lane 1 is polynucleotides of xylan β-1,4-xylosidase of SEQ ID NO. 268 and lane M is DNA molecular weight ladder.
Figure 83:
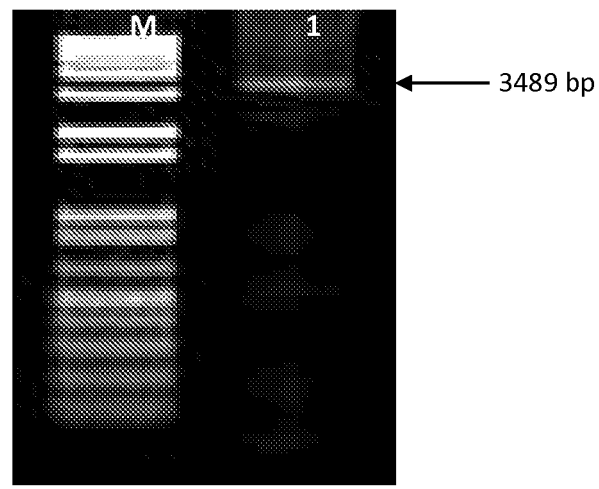
FIG. 83 is the electrophoresed agarose gel image showing the PCR amplification result in which lane 1 is polynucleotides of xylan β-1,4-xylosidase of SEQ ID NO. 271 and lane M is DNA molecular weight ladder.
Figure 84:
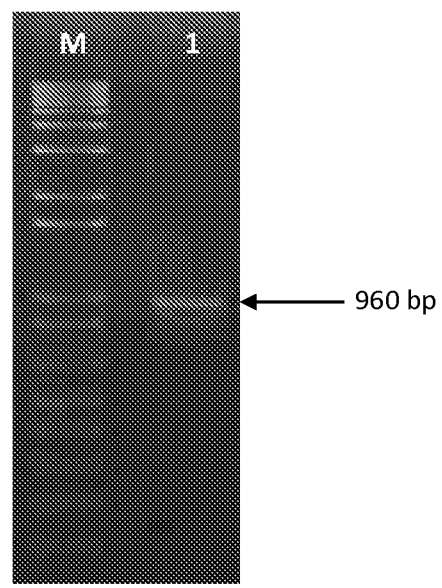
FIG. 84 is the electrophoresed agarose gel image showing the PCR amplification result in which lane 1 is polynucleotides of xylan β-1,4-xylosidase of SEQ ID NO. 274 and lane M is DNA molecular weight ladder.
Figure 85:
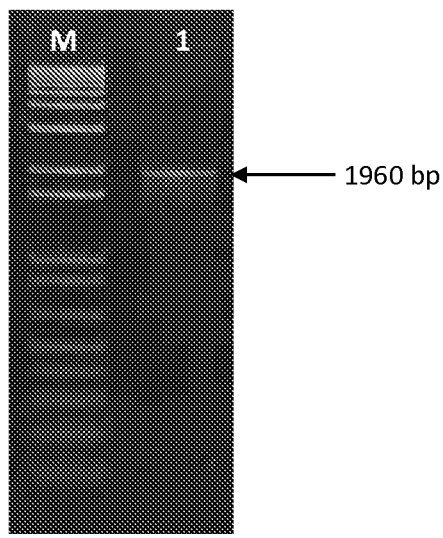
FIG. 85 is the electrophoresed agarose gel image showing the PCR amplification result in which lane 1 is polynucleotides of xylan β-1,4-xylosidase of SEQ ID NO. 277 and lane M is DNA molecular weight ladder.
Figure 86:
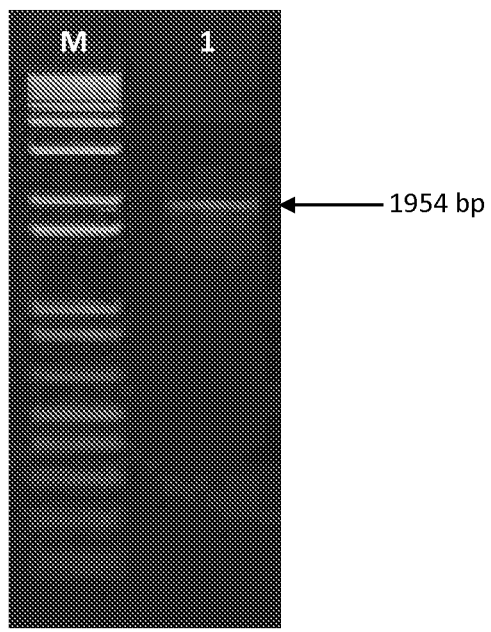
FIG. 86 is the electrophoresed agarose gel image showing the PCR amplification result in which lane 1 is polynucleotides of xylan β-1,4-xylosidase of SEQ ID NO. 280 and lane M is DNA molecular weight ladder.
Figure 87:
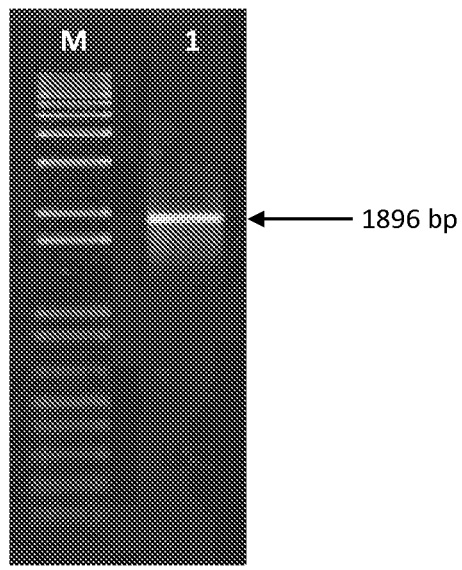
FIG. 87 is the electrophoresed agarose gel image showing the PCR amplification result in which lane 1 is polynucleotides of xylan β-1,4-xylosidase of SEQ ID NO. 283 and lane M is DNA molecular weight ladder.
Figure 88:
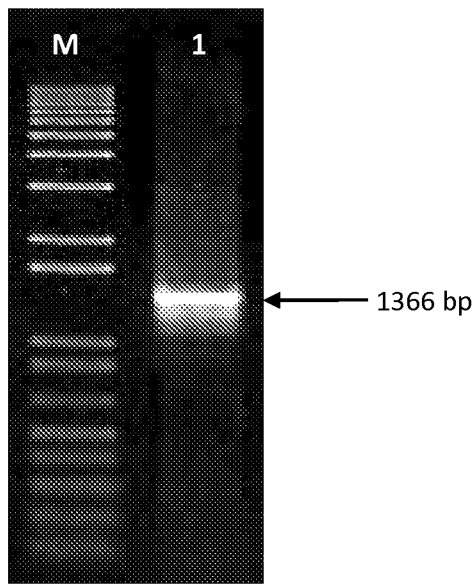
FIG. 88 is the electrophoresed agarose gel image showing the PCR amplification result in which lane 1 is polynucleotides of endo-1,5-α-arabinosidase of SEQ ID NO. 292 and lane M is DNA molecular weight ladder.
Figure 89:
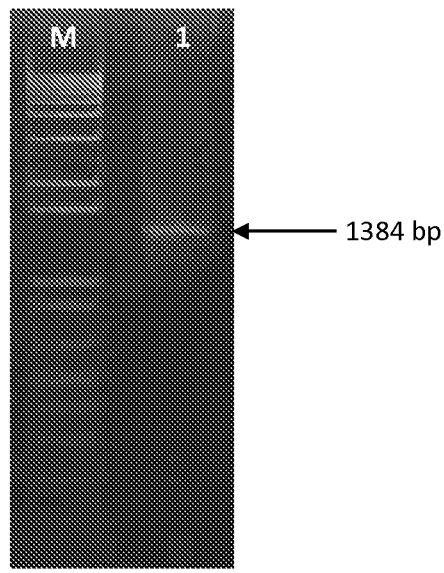
FIG. 89 is the electrophoresed agarose gel image showing the PCR amplification result in which lane 1 is polynucleotides of endo-1,5-α-arabinosidase of SEQ ID NO. 295 and lane M is DNA molecular weight ladder.
Figure 90:
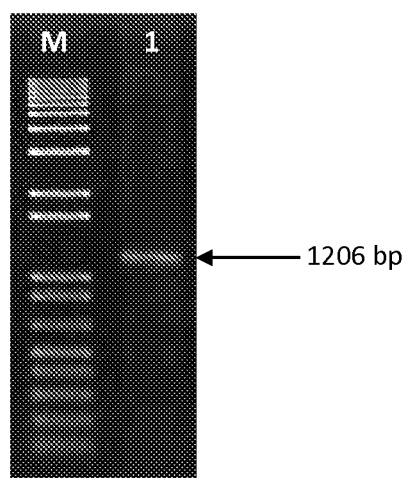
FIG. 90 is the electrophoresed agarose gel image showing the PCR amplification result in which lane 1 is polynucleotides of endo-1,5-α-arabinosidase of SEQ ID NO. 298 and lane M is DNA molecular weight ladder.
Figure 91:
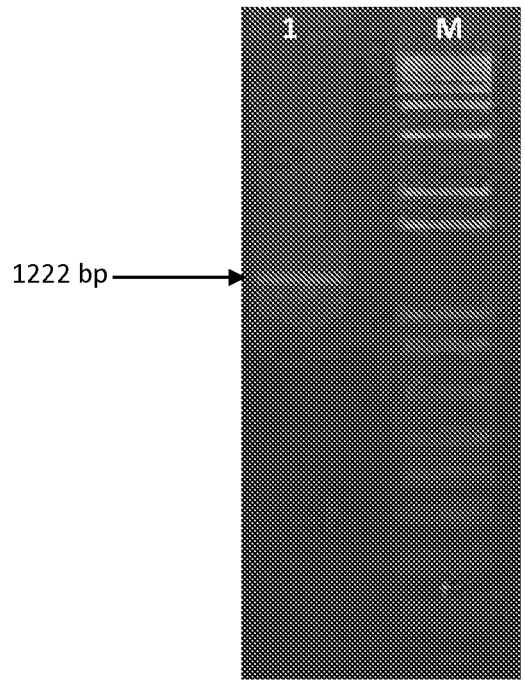
FIG. 91 is the electrophoresed agarose gel image showing the PCR amplification result in which lane 1 is polynucleotides of endo-1,4-β-xylanase of SEQ ID NO. 304 and lane M is DNA molecular weight ladder.
Figure 92:
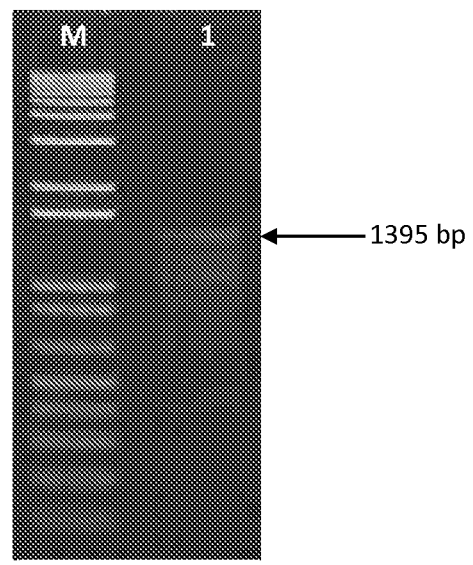
FIG. 92 is the electrophoresed agarose gel image showing the PCR amplification result in which lane 1 is polynucleotides of endo-1,4-β-xylanase of SEQ ID NO. 307 and lane M is DNA molecular weight ladder.
Figure 93:
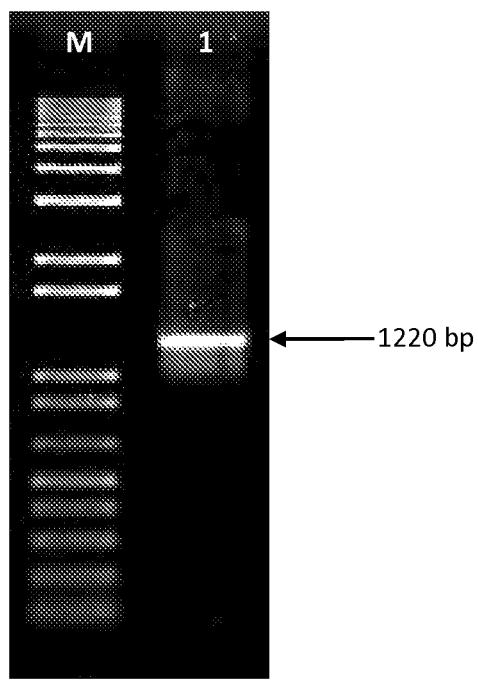
FIG. 93 is the electrophoresed agarose gel image showing the PCR amplification result in which lane 1 is polynucleotides of endo-1,4-β-xylanase of SEQ ID NO. 310 and lane M is DNA molecular weight ladder.
Figure 94:
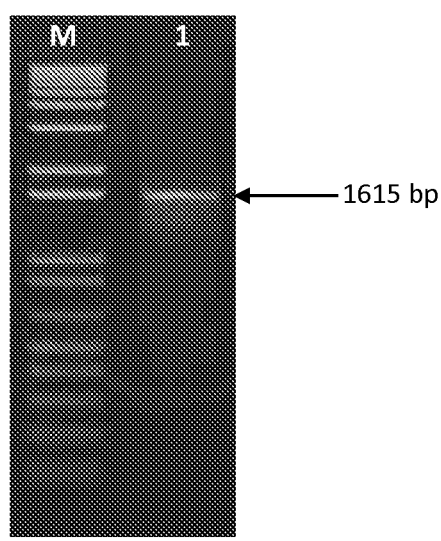
FIG. 94 is the electrophoresed agarose gel image showing the PCR amplification result in which lane 1 is polynucleotides of endo-1,4-β-xylanase of SEQ ID NO. 313 and lane M is DNA molecular weight ladder.
Figure 95:
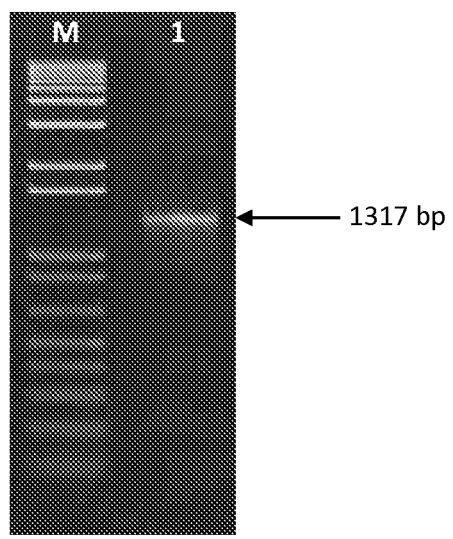
FIG. 95 is the electrophoresed agarose gel image showing the PCR amplification result in which lane 1 is polynucleotides of α-arabinofuranosidase of SEQ ID NO. 316 and lane M is DNA molecular weight ladder.
Figure 96:
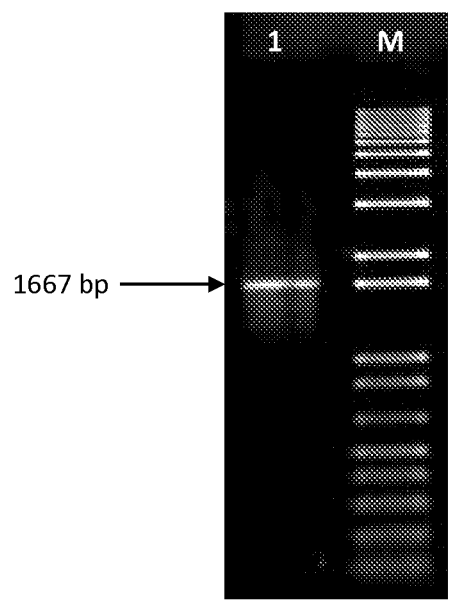
FIG. 96 is the electrophoresed agarose gel image showing the PCR amplification result in which lane 1 is polynucleotides of α-arabinofuranosidase of SEQ ID NO. 319 and lane M is DNA molecular weight ladder.
Figure 97:
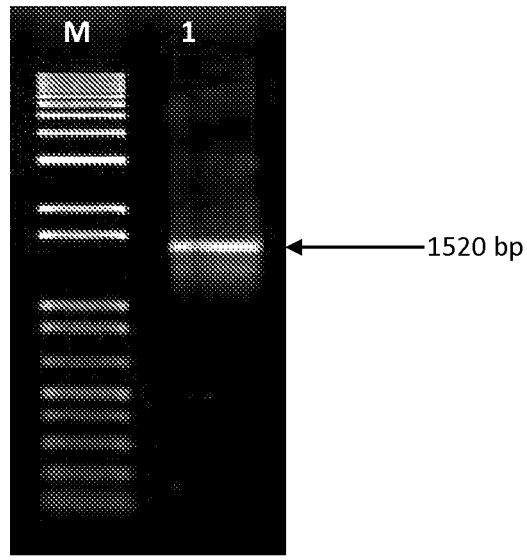
FIG. 97 is the electrophoresed agarose gel image showing the PCR amplification result in which lane 1 is polynucleotides of α-arabinofuranosidase of SEQ ID NO. 322 and lane M is DNA molecular weight ladder.
Figure 98:
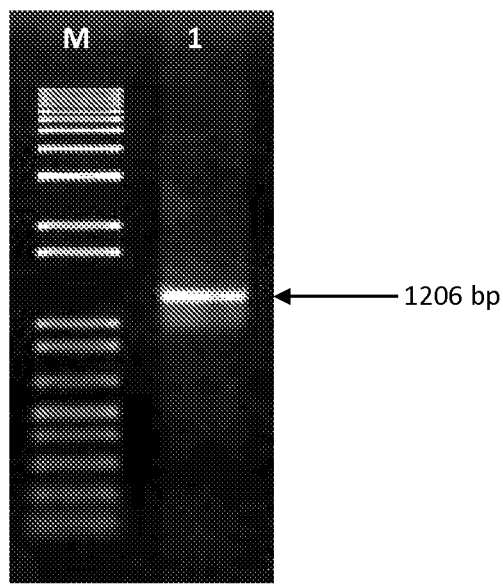
FIG. 98 is the electrophoresed agarose gel image showing the PCR amplification result in which lane 1 is polynucleotides of α-arabinofuranosidase of SEQ ID NO. 325 and lane M is DNA molecular weight ladder.
Figure 99:
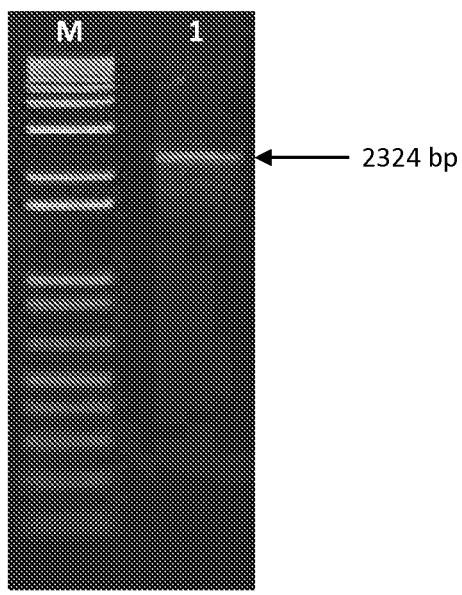
FIG. 99 is the electrophoresed agarose gel image showing the PCR amplification result in which lane 1 is polynucleotides of α-arabinofuranosidase of SEQ ID NO. 328 and lane M is DNA molecular weight ladder.
Figure 100:
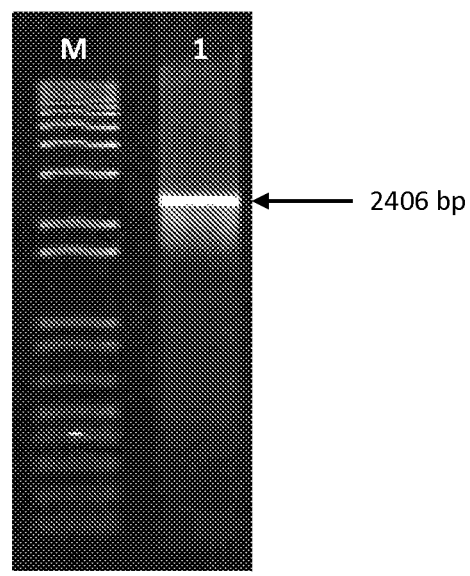
FIG. 100 is the electrophoresed agarose gel image showing the PCR amplification result in which lane 1 is polynucleotides of α-arabinofuranosidase of SEQ ID NO. 331 and lane M is DNA molecular weight ladder.
Figure 101:
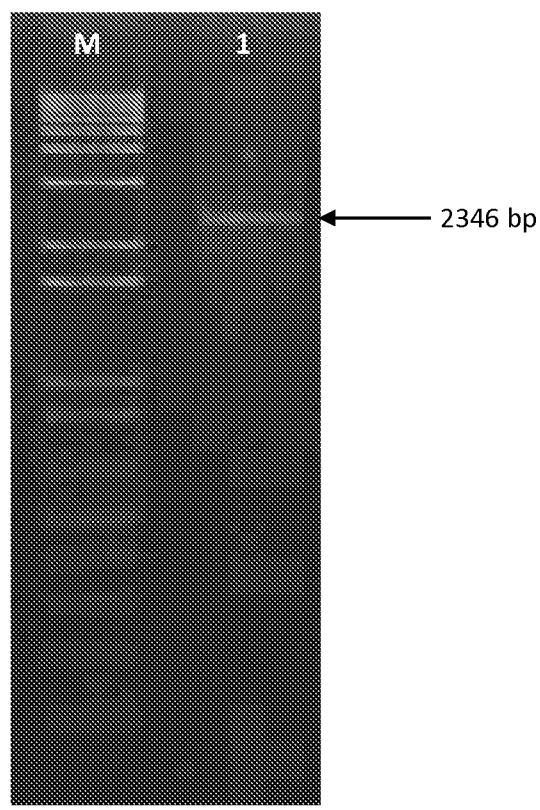
FIG. 101 is the electrophoresed agarose gel image showing the PCR amplification result in which lane 1 is polynucleotides of β-galactosidase of SEQ ID NO. 337 and lane M is DNA molecular weight ladder.
Figure 102:
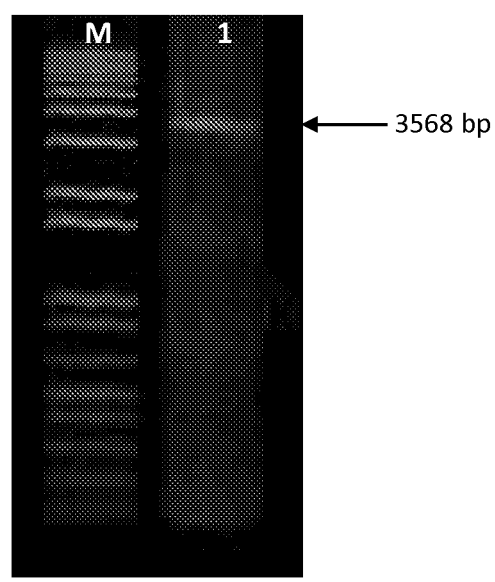
FIG. 102 is the electrophoresed agarose gel image showing the PCR amplification result in which lane 1 is polynucleotides of β-galactosidase of SEQ ID NO. 340 and lane M is DNA molecular weight ladder.
Figure 103:
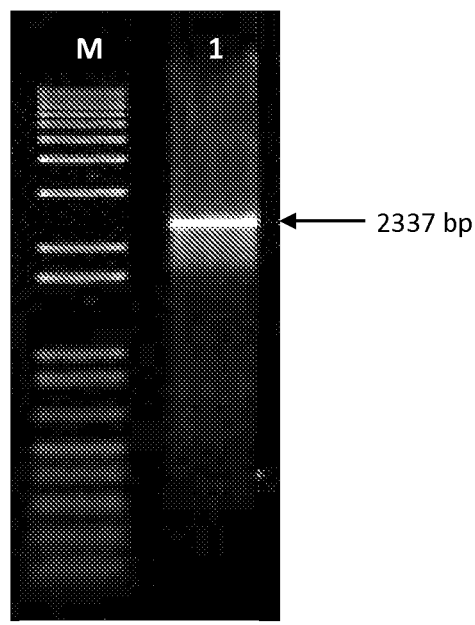
FIG. 103 is the electrophoresed agarose gel image showing the PCR amplification result in which lane 1 is polynucleotides of β-galactosidase of SEQ ID NO. 343 and lane M is DNA molecular weight ladder.
Figure 104:
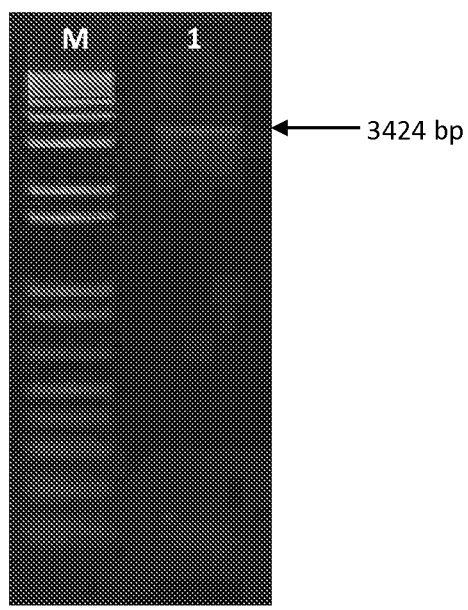
FIG. 104 is the electrophoresed agarose gel image showing the PCR amplification result in which lane 1 is polynucleotides of β-galactosidase of SEQ ID NO. 346 and lane M is DNA molecular weight ladder.
Figure 105:
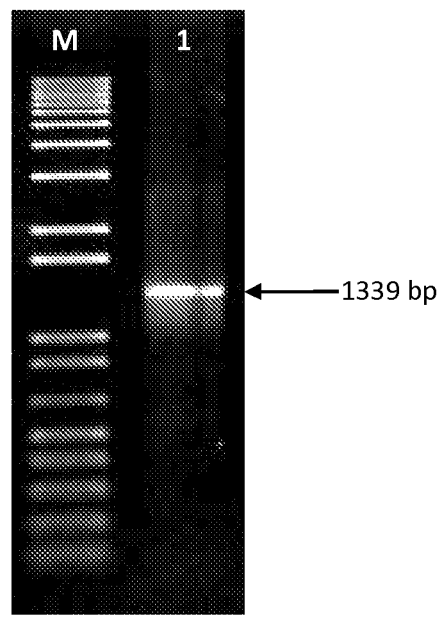
FIG. 105 is the electrophoresed agarose gel image showing the PCR amplification result in which lane 1 is polynucleotides of endo-1,4β-galactanase of SEQ ID NO. 352 and lane M is DNA molecular weight ladder.
Figure 106:
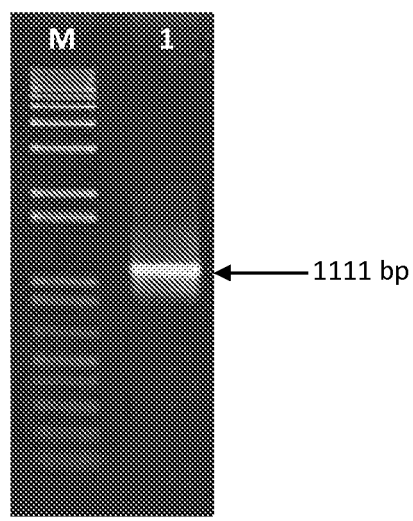
FIG. 106 is the electrophoresed agarose gel image showing the PCR amplification result in which lane 1 is polynucleotides of endo-1,4β-galactanase of SEQ ID NO. 355 and lane M is DNA molecular weight ladder.
Figure 107:
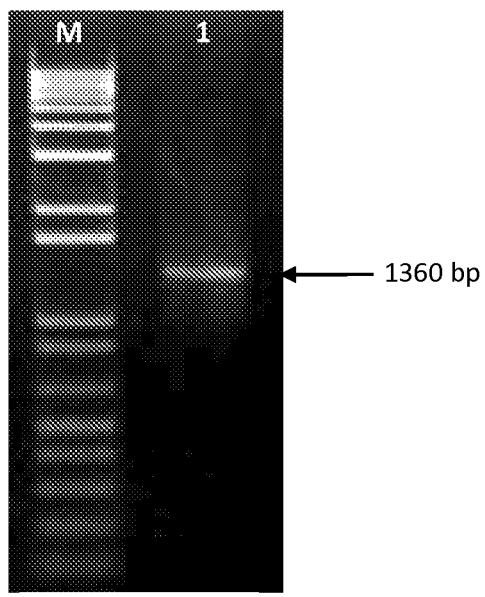
FIG. 107 is the electrophoresed agarose gel image showing the PCR amplification result in which lane 1 is polynucleotides of endo-1,4β-galactanase of SEQ ID NO. 358 and lane M is DNA molecular weight ladder.
Figure 108:
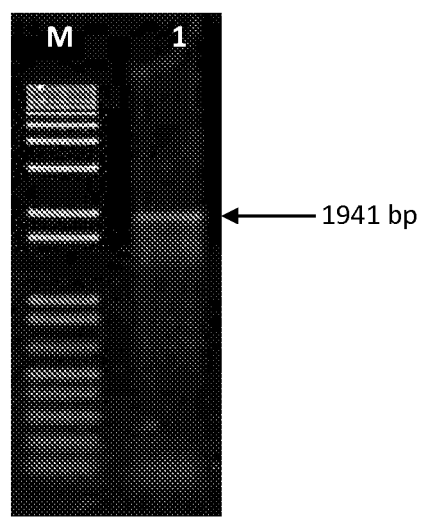
FIG. 108 is the electrophoresed agarose gel image showing the PCR amplification result in which lane 1 is polynucleotides of endo-1,6β-galactanase of SEQ ID NO. 361 and lane M is DNA molecular weight ladder.
Figure 109:
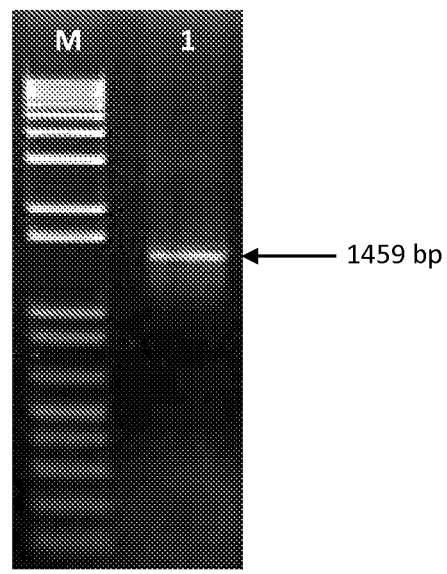
FIG. 109 is the electrophoresed agarose gel image showing the PCR amplification result in which lane 1 is polynucleotides of endo-1,4-β-mannanase of SEQ ID NO. 364 and lane M is DNA molecular weight ladder.

The definitions and/or methods provided herein define the present invention and guide those of ordinary skill in the art in the practice of the present invention. Except where otherwise stated, terms are to be understood according to conventional usage by those of ordinary skill in the relevant art. To the extent to which any of the definitions and/or methods is found to be inconsistent with any of the definitions and/or methods provided in any patent or non-patent reference incorporated herein or in any reference found elsewhere, it is understood that the said definition and/or method which has been expressly provided/adopted in this application will be used herein. The singular terms "a," "an," and "the" include plural referents unless context clearly indicates otherwise. Similarly, the word "or" is intended to include "and" unless the context clearly indicates otherwise. Hence "comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present disclosure, suitable methods and materials are described below.

The present invention provides the nucleotide sequences of *M. phaseolina* genes involved in cellulose and/or hemicelluloses degradation. The genes encode proteins with cellulolytic activity that is either in use in an industry or of interest to an industry. Described herein below are the genes that encode cellulolytic enzymes of the invention, their identification, characterization, modification, and methods of use in various industrial processes.

The nucleotide sequences of *M. phaseolina* genomic DNA was obtained by a whole-genome random shotgun DNA sequencing effort. The genomic DNA was prepared from an isolate of *M. phaseolina* ms6 strain which was isolated from the infected jute (*Corchorus* spp.) plant. The generated nucleotide sequences were assembled to form contigs and scaffolds by the Newbler assembler. The nucleotide sequences were initially annotated by software programs, such as Augustus, Glimmer M (The Institute of Genome Research, Rockville, Md.) and Evidence Modeler (EVM), which can identify putative coding regions, introns, and splice junctions. Further, automated and manual curation of the nucleotide sequences was performed to refine and establish precise characterization of the coding regions and other gene features.

The genomic sequences of the invention that encode the cellulose and/or hemicellulose degrading enzymes are identified primarily by comparison of nucleotide sequences of *M. phaseolina* genomic DNA and the nucleotide sequences of known enzyme genes of other microorganisms. Prior to this invention, the nucleotide sequences of these *M. phaseolina* genes (involved in cellulose and/or hemicelluloses degradation), the reading frames, the positions of exons and introns, the structure of the enzymes, and their potential usefulness in various industries, including those involved in the making of food and feed, beverages, textiles, bioethanol and detergents, were not known.

Over 14000 cDNAs from *M. phaseolina* were partially or fully sequenced. Among them one hundred and thirty four cDNAs encoding new enzymes with putative roles in cellulose and/or hemicellulose degradation were discovered.

Open reading frames (ORFs) are analyzed following full or partial sequencing of clones of cDNA libraries derived from *M. phaseolina* mRNA and are further analyzed using sequence analysis software, and by determining homology to known sequences in databases (public/private).

In the context of this disclosure, a number of terms used throughout the specification have the indicated meanings unless expressly indicated to have a different meaning.

The term "cellulolytic activity", as used herein, is defined as a biological activity which hydrolyzes a cellulosic material. For purposes of the present invention, cellulolytic activity is determined by measuring the increase in hydrolysis of a cellulosic material by a cellulolytic mixture in an appropriate/effective conditions, for example, an appropriate/effective amount (such as, 1-10 mg) of cellulolytic protein/g of cellulose in pretreated corn stover (PCS) for an appropriate/effective number of days (such as, 5-7 day) at an appropriate/effective level of temperature (such as 50° C.), which is then compared to a controlled hydrolysis without addition of cellulolytic protein.

The term "PCS" or "Pre-treated Corn Stover", as used herein, is defined as a cellulosic material derived from corn stover by treatment with heat and dilute acid.

The term "cellulose" is intended to include soluble and insoluble, amorphous and crystalline forms of cellulose.

The term "hemicellulose" is intended to include glucans, mannans, xylans, arabinans or polyglucuronic or polygalacturonic acid.

The term "cellulosic material" is defined herein as any material containing cellulose. Cellulose is generally found, for example, in the stems, leaves, hulls, husks, and cobs of plants or leaves, branches, and wood of trees. The cellulosic material can also be, but is not limited to, found in herbaceous material, agricultural residues, forestry residues, municipal solid wastes, waste paper, and pulp and paper mill residues. It is understood herein that the cellulose may be in the form of lignocellulose, which is a plant cell wall material containing lignin, cellulose, and hemicellulose in a mixed condition.

The term "gene", as used herein (unless stated/inferred otherwise), is generally defined as the genomic sequences of the fungus *M. phaseolina* (or any of its strain), particularly polynucleotide sequence encoding polypeptide of the series of enzymes involved in cellulose and/or hemicellulose degradation. The term can further include nucleic acid molecules comprising upstream, downstream, and/or intron nucleotide sequences.

The term "open reading frame (ORF)," means a series of nucleotide triplets coding for amino acids without any termination codons and the triplet sequence is translatable into protein using the codon usage information appropriate for a particular organism.

A "coding sequence" or "coding region" refers to a nucleic acid molecule having sequence information necessary to produce a gene product, such as an amino acid or polypeptide, when the sequence is expressed. The coding sequence may comprise untranslated sequences (including introns or 5' or 3' untranslated regions) within translated regions, or may lack such intervening untranslated sequences (e.g., as in cDNA).

The term "cDNA" is defined herein as a DNA molecule which can be prepared by reverse transcription from a mature, spliced, mRNA molecule obtained from a eukaryotic cell. cDNA lacks intron sequences that are usually present in the corresponding genomic DNA. The initial, primary RNA transcript is a precursor to mRNA which is processed through a series of steps before appearing as mature spliced mRNA. These steps include the removal of intron sequences by a process called splicing.

As used herein, a "polynucleotide" is a nucleotide sequence such as a nucleic acid fragment. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures and/or combination thereof. An isolated polynucleotide of the present invention may be derived from, but not limited to, SEQ ID Nos. 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364, or any complement of such sequences.

"Isolated" means altered "by the hand of man" from the natural state. If a composition or substance occurs in nature, it would be considered as "isolated" if it has been changed or removed from its original environment, or both. For example, a polynucleotide or a polypeptide naturally present in a living plant or animal is not "isolated," but the same polynucleotide or polypeptide separated from the coexisting materials of its natural state is "isolated", as the term is employed herein.

The term "recombinant," when used herein to refer to a polypeptide or protein, normally means that a polypeptide or protein is derived from recombinant (e.g., microbial or mammalian) expression systems. "Microbial" refers to recombinant polypeptides or proteins made in bacterial or fungal expression systems. Polypeptides or proteins expressed in most bacterial systems, e.g., E. coli, will be free of glycosylation modifications; polypeptides or proteins expressed in fungi will be glycosylated.

A "vector" generally refers to a replicon, such as plasmid, phage, cosmid, yeast or virus, or an artificial replicating sequence (ARS) or an artificial chromosome for expressing a polypeptide from a nucleotide sequence. The term "vector" is also intended to refer to a nucleic acid molecule capable of transporting another nucleic acid to which it has been linked. One type of vector is a "plasmid," which refers to a circular double-stranded DNA loop into which additional DNA segments may be ligated. Another type of vector is a viral vector, where additional DNA segments may be ligated into the viral genome. Certain vectors are capable of autonomous replication in a host cell into which they are introduced (e.g., bacterial vectors having a bacterial origin of replication and episomal mammalian vectors). Other vectors can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term "expression vector" is defined herein as a linear or circular DNA molecule that comprises a polynucleotide encoding a polypeptide of the invention, which is operably linked to additional nucleotides that provide for its expression.

The term "expression construct" can comprise an assembly of a genetic element(s) having a regulatory role in gene expression, for example, promoters or enhancers, or a coding sequence which is transcribed into RNA, mRNA and translated into protein, and which is operably linked to promoter or appropriate transcription initiation and termination sequences.

The term "operably linked" denotes herein a configuration in which a control sequence is placed at an appropriate position relative to the coding sequence of the polynucleotide sequence such that the control sequence directs the expression of the coding sequence of a polypeptide.

The term "host cell" refers to a cell from any organism. Preferred host cells are derived from plants, bacteria, yeast, fungi, insects, or other animals. It should be understood that the term "host cell" is intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein. The term "host cell", as used herein, includes any cell type which is susceptible to transformation, transfection, transduction, and the like with a nucleic acid construct or expression vector comprising a polynucleotide of the present invention. Methods for introducing polynucleotide sequences into various types of host cells are well known in the art. Provided are host cells or progeny of host cells transformed with the recombinant expression cassettes of the present invention. The host cells may be plant cells. Preferably, the plant cells are jute cells.

The term "nucleic acid construct" as used herein refers to a nucleic acid molecule, either single- or double-stranded, which is isolated from a naturally occurring gene or which is modified to contain segments of nucleic acids in a manner that would not otherwise exist in nature. The term nucleic acid construct is synonymous with the term "expression cassette" when the nucleic acid construct contains the control sequences required for expression of a coding sequence of the present invention.

The term "recombinant host cells" means cultured cells which comprises a recombinant transcriptional unit, and will express heterologous polypeptides or proteins, and RNA encoded by the DNA segment or synthetic gene in the recombinant transcriptional unit. The cells can be prokaryotic or eukaryotic.

"Polypeptide" as used herein, is a single linear chain of amino acids bonded together by peptide bonds, and having a sequence greater than 100 amino acids in length.

The term "promoter" as used herein, generally refers to a nucleic acid sequence that functions to direct transcription of a downstream gene. The promoter will generally be appropriate to the host cell in which the target gene is being expressed. The promoter together with other transcriptional and translational regulatory nucleic acid sequences (also termed "control sequences") is necessary to express a given gene. In general, the transcriptional and translational regulatory sequences include, but are not limited to, promoter sequences, ribosomal binding sites, transcriptional start and stop sequences, translational start and stop sequences, and enhancer or activator sequences.

The term "in vitro" as used herein, refers to a biological reaction occurs in an artificial environment outside a living organism, which is usually conducted in a laboratory using components of an organism that have been isolated from their usual biological context in order to permit a more detailed or more convenient analysis to be performed.

The term "% homology" is used interchangeably herein with the term "% identity" herein and normally refers to the level of nucleic acid or amino acid sequence identity between the nucleic acid sequence that encodes any one of the inventive polypeptides or the inventive polypeptide's amino acid sequence, when aligned using a sequence alignment program.

For example, as used herein, 80% homology means the same thing as 80% sequence identity determined by a defined algorithm, and accordingly a homologue of a given sequence has greater than 80% sequence identity over a length of the given sequence. Exemplary levels of sequence identity include, but are not limited to, 80, 85, 90, 95, 98% or more sequence identity to a given sequence, e.g., the coding sequence for any one of the inventive polypeptides, as described herein.

Exemplary computer programs which can be used to determine identity between two sequences include, but are not limited to, the suite of BLAST programs, e.g., BLASTN, BLASTX, and TBLASTX, BLASTP and TBLASTN, publicly accessible at www.ncbi.nlm.nih.gov/BLAST.

Sequence searches are typically carried out using the BLASTN program when evaluating a given nucleic acid sequence relative to nucleic acid sequences in the GenBank DNA Sequences and other public databases. The BLASTX program is preferred for searching nucleic acid sequences that have been translated in all reading frames against amino acid sequences in the GenBank Protein Sequences and other public databases.

A preferred alignment of selected sequences in order to determine "% identity" between two or more sequences is performed using for example the CLUSTAL-W program.

The term "primer" as used herein, is an oligonucleotide capable of binding to a target nucleic acid sequence and priming the nucleic acid synthesis. An amplification oligonucleotide as defined herein will preferably be 10 to 50, most preferably 15 to 25 nucleotides in length. While the amplification oligonucleotides of the present invention may be chemically synthesized such oligonucleotides are not naturally occurring nucleic acids. The abbreviation used throughout the specification to refer to nucleic acids comprising nucleotide sequences are the conventional one-letter abbreviations. Thus when included in a nucleic acid, the naturally occurring encoding nucleotides are abbreviated as follows: adenine (A), guanine (G), cytosine (C), thymine (T) and uracil (U). Also, unless otherwise specified, the nucleic acid sequences presented herein is the 5'→3' direction.

As used herein, the term "complementary" and derivatives thereof are used in reference to pairing of nucleic acids by the well-known rules that A pairs with T or U and C pairs with G. Complement can be "partial" or "complete". In partial complement, only some of the nucleic acid bases are matched according to the base pairing rules; while in complete or total complement, all the bases are matched according to the pairing rule. The degree of complement between the nucleic acid strands may have significant effects on the efficiency and strength of hybridization between nucleic acid strands as well known in the art. The efficiency and strength of said hybridization is depends upon in detection method. The DNA sequences of the invention were generated by sequencing reactions and may contain minor errors which may exist as misidentified nucleotides, insertions, and/or deletions. However, such minor errors, if present, should not disturb the identification of the sequences as a gene of M. phaseolina that encodes an enzyme of industrial interest, and are specifically included within the scope of the invention.

Encompassed by the present invention are genomic nucleotide sequences and coding sequences of genes that encode enzymes of *M. phaseolina* of industrial interest. Accordingly, in one embodiment, SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362 and 365 are provided each of which identifies a nucleotide sequence of the opening reading frame (ORF) of an identified gene. In another embodiment, the genomic sequences of the genes identified by SEQ ID Nos. 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364 are provided.

As used herein, "gene" also refers to (i) a gene comprising at least one of the nucleotide sequences and/or fragments thereof that are set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364; (ii) any nucleotide sequence or fragment thereof that encodes the amino acid sequence that are set forth in SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366; (iii) any nucleotide sequence that hybridizes to the complement of the nucleotide sequences set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364 under medium stringency conditions, e.g., hybridization to filter-bound DNA in an appropriate/effective amount of 6× sodium chloride/sodium citrate (SSC) at an appropriate/effective level of temperature (such as, 45° C.) followed by one or more washes in an appropriate/effective level of SDS, such as 0.2×SSC/0.1% SDS at an appropriate/effective level of temperature (such as, 50 to 65° C.), or under highly stringent conditions, e.g., hybridization to filter-bound nucleic acid in an appropriate/effective amount of 6×SSC at an appropriate/effective level of temperature (such as, 45° C.) followed by one or more washes in an appropriate/effective level of SDS (such as, 0.1×SSC/0.2% SDS) at an appropriate/effective level of temperature (such as, 68° C.), or under other hybridization conditions which are apparent to those of skill in the art (see, for example, Ausubel F M, Brent R, Kingston R E, Moore D D, Seidman J G, Smith J A, Struhl K. Current Protocols in Molecular Biology, 1994; Green Publishing Associates, Inc. and John Wiley & Sons, Inc., New York). Preferably, the polynucleotides that hybridize to the complements of the DNA sequences disclosed herein encode gene products, e.g., gene products that are functionally equivalent to a gene product encoded by one of the enzyme genes or fragments thereof.

As described above, gene sequences include not only degenerate nucleotide sequences that encode the amino acid sequences of SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366, but also degenerate nucleotide sequences that when translated in organisms other than *M. phaseolina*, would yield a polypeptide comprising one of the amino acid sequences of SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366, or a fragment thereof. One of skill in the art would know how to select the appropriate codons or modify the nucleotide sequences of SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364, when using the gene sequences in *M. phaseolina* or in other organisms. For example, in *Candida albicans*, the codon CTG encodes a serine residue instead of leucine residue.

The nucleotide sequences of the invention can be used as genetic markers and/or sequence markers to aid the development of a genetic, physical, or sequence map of the *M. phaseolina* genome. The nucleotide sequences and corresponding gene products of the invention can also be used to detect the presence of *M. phaseolina*. Hybridization and antibody-based methods well known in the art can be used to determine the presence and concentration of the nucleotide sequences and corresponding gene products of the invention.

The nucleotide sequences can also be used for identifying inhibitors of the enzymes which may have therapeutic effects, given the fact that the enzymes may play a role in the invasion of a host during an infection.

In another embodiment, in addition to the nucleotide sequences of *M. phaseolina* described above, homologs or orthologs of the genes of the invention as can be present in *M. phaseolina* and other fungal species are also included. Particularly preferred are homologs or orthologs in filamentous fungi. These enzyme genes can be identified and isolated by molecular biological techniques well known in the art.

The term "Fungi" as used herein includes the phyla Ascomycota, Basidiomycota, Chytridiomycota, and Zygomycota (Hawksworth D L, Kirk P M, Sutton B C, Pegler D N. Ainsworth and Bisby's Dictionary of the Fungi (8th Ed.). 1995; CAB International, Wallingford, United Kingdom. 616p) and yeast. Representative groups of Ascomycota include, e.g., *Neurospora, Penicillium, Aspergillus*. Representative groups of Basidiomycota include mushrooms, rusts, and smuts. Representative groups of Chytridiomycota include *Allomyces, Blastocladiella, Coelomomyces*. Representative groups of Zygomycota include, e.g., *Rhizopus* and *Mucor*.

The term "Filamentous fungi" include all filamentous forms of fungi. The filamentous fingi are characterized by a vegetative mycelium composed of chitin, cellulose, glucan, chitosan, mannan, and other complex polysaccharides. Vegetative growth is by hyphal elongation and carbon catabolism is obligately aerobic.

Accordingly, the present invention provides fungal nucleotide sequences that are hybridizable to the polynucleotides of the genes. In one embodiment, the present invention includes an isolated nucleic acid comprising and/or consisting of a nucleotide sequence that is at least 50% identical to a nucleotide sequence selected from the group comprising and/or consisting of: SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364.

In another embodiment, the present invention includes an isolated nucleic acid comprising a fungal nucleotide sequence that hybridizes under medium stringency conditions to a second nucleic acid that comprises and/or consists of a nucleotide sequence selected from the group comprising and/or consisting of SEQ ID NO. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364.

In yet another embodiment, the present invention includes an isolated nucleic acid comprising a fungal nucleotide sequence that encodes a polypeptide the amino acid sequence of which is at least 50% identical to an amino acid sequence selected from the group comprising and/or consisting of SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366.

The nucleotide sequences of the invention still further include fungal nucleotide sequences that have at least 40%, 45%, 50%, 55%, 60%, 65%, 70%, 75%, 80%, 85%, 90%, 95%, 96%, 97%, 98%, 99% or more nucleotide sequence identity to the nucleotide sequences set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364.

To isolate homologous genes, the *M. phaseolina* gene sequence described above can be labeled and used to screen a cDNA library constructed from mRNA obtained from the organism of interest, including but not limited to *M. phaseolina*. Accordingly, nucleic acid probes, preferably detectably labeled, comprising of any one of the nucleotide sequences of SEQ ID NO. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364 are included. Hybridization conditions should be of a lower stringency when the cDNA library was derived from an organism different from the type of organism from which the labeled sequence was derived. cDNA screening can also identify clones derived from alternatively spliced transcripts in the same species. Alternatively, the labeled probe can be used to screen a genomic library derived from the organism of interest, again, using appropriately stringent conditions. Low stringency conditions will be well known to those of skill in the art, and will vary predictably depending on the specific organisms from which the library and the labeled sequences are derived. (Details in Sambrook J, Russell D W. Molecular Cloning, A Laboratory Manual, Third edition, 2001, Cold Spring Harbor Press, N.Y.; and Ausubel F M, Brent R, Kingston R E, Moore D D, Seidman J G, Smith J A, Struhl K. Current Protocols in Molecular Biology, 1994; Green Publishing Associates, Inc. and John Wiley & Sons, Inc., New York).

Further, a homologous gene sequence can be isolated by performing a polymerase chain reaction (PCR) using two degenerate oligonucleotide primer pools designed on the basis of amino acid sequences within the gene of interest. The template for the reaction can be cDNA obtained by reverse transcription of mRNA prepared from the organism of interest. The PCR product can be subcloned and sequenced to ensure that the amplified sequences represent the sequences of a homologous enzyme gene sequence.

The PCR fragment can then be used to isolate a full length cDNA clone by a variety of methods well known to those of ordinary skill in the art. Alternatively, the labeled fragment can be used to screen a genomic library.

In another embodiment of the invention, the *M. phaseolina* gene sequences can be used in developing modified or novel enzymes that exhibit particularly desirable chemical and/or physical characteristics. Because of the apparent relatedness of the amino acid sequences among the enzymes of *M. phaseolina* and other filamentous fungi, the structure of an enzyme of another fungus can be used to predict the structure of the *M. phaseolina* enzyme, and aid in the rational modification of the *M. phaseolina* enzyme for useful and superior properties. The sequences provided by the present invention can also be used as starting materials for the rational modification or design of novel enzymes with characteristics that enable the enzymes to perform better in demanding processes.

The gene nucleotide sequences can be altered by random and site-directed mutagenesis techniques or directed molecular evolution techniques, such as but not limited to the methods described in (Arnold F H. Protein engineering for unusual environments. Curr. Opinion Biotechnol. 1993; 4:450-455), oligonucleotide-directed mutagenesis (Reidhaar-Olson J F, Sauer R T. Combinatorial cassette mutagenesis as a probe of the informational content of protein sequences. Science, 1988; 241:53-57), chemical mutagenesis (Eckert K A, Drinkwater N R. recA-dependent and recA-independent N-ethyl-N-nitrosourea mutagenesis at a plasmid-encoded herpes simplex virus thymidine kinase gene in *Escherichia coli*. Mutat Res. 1987; 178:1-10), site-directed mutagenesis (Kunkel T A. Rapid and efficient site-specific mutagenesis without phenotypic selection. Proc. Natl. Acad. Sci. USA, 1985; 82:488-492; Oliphant A, Nussbaum A L, Struhl K. Cloning of random-sequence oligodeoxynucleotides. Gene 1986; 44 177-183), error prone PCR (Cadwell R C, Joyce G F. Randomization of genes by PCR mutagenesis. PCR Methods Appl. 1992; 2:28-33), cassette mutagenesis (Stauss Hj, Davies H, Sadovnikova E, Chain B, Horowitz N, Sinclair C. Induction of cytotoxic T lymphocytes with peptides in vitro: identification of candidate T-cell epitopes in human papilloma virus. PNAS 1992; 89(17): 7871-7875) DNA shuffling methods as described in Stemmer W P. DNA shuffling by random fragmentation and reassembly: in vitro recombination for molecular evolution. PNAS 1994; 91(22):10747-10751 and in U.S. Pat. Nos. 5,605,793; 6,117,679; and 6,132,970, and the methods as described in U.S. Pat. Nos. 5,939,250, 5,965,408, 6,171,820. The mutations in the nucleotide sequence can be determined by sequencing the gene in the clones.

In one embodiment, the 699 bp long polynucleotide illustrated in SEQ ID NO. 2 is the full length cDNA clone encoding β-1,4-endoglucanase protein exhibiting an open reading frame encoding 232 amino acid polypeptide, as in SEQ ID NO. 3, with a predicted molecular mass of about 24 kD. Bioinformatic analysis of SEQ ID NO. 2 reveals that this sequence produces β-1,4-endoglucanase protein that specifically cleaves the internal bonds of the cellulose chain.

In another embodiment, the 696 bp long polynucleotide illustrated in SEQ ID NO. 5 is the full length cDNA clone encoding β-1,4-endoglucanase protein exhibiting an open reading frame encoding 231 amino acid polypeptide, as in SEQ ID NO. 6, with a calculated molecular mass of about 24 kD. Bioinformatic analysis of SEQ ID NO. 5 reveals that this sequence produces β-1,4-endoglucanase protein that specifically cleaves the internal bonds of the cellulose chain.

In another embodiment, the 786 bp long polynucleotide illustrated in SEQ ID NO. 8 is the full length cDNA clone encoding β-1,4-endoglucanase protein exhibiting an open reading frame encoding 261 amino acid polypeptide, as in SEQ ID NO. 9, with a calculated molecular mass of about 28 kD. Bioinformatic analysis of SEQ ID NO. 8 reveals that this sequence produces β-1,4-endoglucanase protein that specifically cleaves the internal bonds of the cellulose chain.

In another embodiment, the 873 bp long polynucleotide illustrated in SEQ ID NO. 11 is the full length cDNA clone encoding β-1,4-endoglucanase protein exhibiting an open reading frame encoding 290 amino acid polypeptide, as in SEQ ID NO. 12, with a calculated molecular mass of about 32 kD. Bioinformatic analysis of SEQ ID NO. 11 reveals that this sequence produces β-1,4-endoglucanase protein that specifically cleaves the internal bonds of the cellulose chain.

In another embodiment, the 732 bp long polynucleotide illustrated in SEQ ID NO. 14 is the full length cDNA clone encoding β-1,4-endoglucanase protein exhibiting an open reading frame encoding 243 amino acid polypeptide, as in SEQ ID NO. 15, with a calculated molecular mass of about 25 kD. Bioinformatic analysis of SEQ ID NO. 14 reveals that this sequence produces β-1,4-endoglucanase protein that specifically cleaves the internal bonds of the cellulose chain.

In another embodiment, the 834 bp long polynucleotide illustrated in SEQ ID NO. 17 is the full length cDNA clone encoding β-1,4-endoglucanase protein exhibiting an open reading frame encoding a 277 amino acid polypeptide, as in SEQ ID NO. 18, with a calculated molecular mass of about 29 kD. Bioinformatic analysis of SEQ ID NO. 17 reveals that this sequence produces β-1,4-endoglucanase protein that specifically cleaves the internal bonds of the cellulose chain.

In another embodiment, the 1431 bp long polynucleotide illustrated in SEQ ID NO. 20 is the full length cDNA clone encoding β-1,4-endoglucanase protein exhibiting an open reading frame encoding 476 amino acid polypeptide, as in SEQ ID NO. 21, with a calculated molecular mass of about 51 kD. Bioinformatic analysis of SEQ ID NO. 20 reveals that this sequence produces β-1,4-endoglucanase protein that specifically cleaves the internal bonds of the cellulose chain.

In another embodiment, the 762 bp long polynucleotide illustrated in SEQ ID NO. 23 is the full length cDNA clone encoding β-1,4-endoglucanase protein exhibiting an open reading frame encoding 253 amino acid polypeptide, as in SEQ ID NO. 24, with a calculated molecular mass of about 27 kD. Bioinformatic analysis of SEQ ID NO. 23 reveals that this sequence produces β-1,4-endoglucanase protein that specifically cleaves the internal bonds of the cellulose chain.

In another embodiment, the 1113 bp long polynucleotide illustrated in SEQ ID NO. 26 is the full length cDNA clone encoding β-1,4-endoglucanase protein exhibiting an open reading frame encoding 370 amino acid polypeptide, as in SEQ ID NO. 27, with a calculated molecular mass of about 38 kD. Bioinformatic analysis of SEQ ID NO. 26 reveals that this sequence produces β-1,4-endoglucanase protein that specifically cleaves the internal bonds of the cellulose chain.

In another embodiment, the 678 bp long polynucleotide illustrated in SEQ ID NO. 29 is the full length cDNA clone encoding β-1,4-endoglucanase protein exhibiting an open reading frame encoding 225 amino acid polypeptide, as in SEQ ID NO. 30, with a calculated molecular mass of about 24 kD. Bioinformatic analysis of SEQ ID NO. 29 reveals that this sequence produces β-1,4-endoglucanase protein that specifically cleaves the internal bonds of the cellulose chain.

In another embodiment, the 669 bp long polynucleotide illustrated in SEQ ID NO. 32 is the full length cDNA clone encoding β-1,4-endoglucanase protein exhibiting an open reading frame encoding 222 amino acid polypeptide, as in SEQ ID NO. 33, with a calculated molecular mass of about 24 kD. Bioinformatic analysis of SEQ ID NO. 32 reveals that this sequence produces β-1,4-endoglucanase protein that specifically cleaves the internal bonds of the cellulose chain.

In another embodiment, the 963 bp long polynucleotide illustrated in SEQ ID NO. 35 is the full length cDNA clone encoding β-1,4-endoglucanase protein exhibiting an open reading frame encoding 320 amino acid polypeptide, as in SEQ ID NO. 36, with a calculated molecular mass of about 35 kD. Bioinformatic analysis of SEQ ID NO. 35 reveals that this sequence produces β-1,4-endoglucanase protein that specifically cleaves the internal bonds of the cellulose chain.

In another embodiment, the 1479 bp long polynucleotide illustrated in SEQ ID NO. 38 is the full length cDNA clone encoding β-1,4-endoglucanase protein exhibiting an open reading frame encoding 492 amino acid polypeptide, as in SEQ ID NO. 39, with a calculated molecular mass of about 58 kD. Bioinformatic analysis of SEQ ID NO. 38 reveals that this sequence produces β-1,4-endoglucanase protein that specifically cleaves the internal bonds of the cellulose chain.

In another embodiment, the 1743 bp long polynucleotide illustrated in SEQ ID NO. 41 is the full length cDNA clone encoding β-1,4-endoglucanase protein exhibiting an open reading frame encoding 580 amino acid polypeptide, as in SEQ ID NO. 42, with a calculated molecular mass of about 64 kD. Bioinformatic analysis of SEQ ID NO. 41 reveals that this sequence produces β-1,4-endoglucanase protein that specifically cleaves the internal bonds of the cellulose chain.

In another embodiment, the 1083 bp long polynucleotide illustrated in SEQ ID NO. 44 is the full length cDNA clone encoding β-1,4-endoglucanase protein exhibiting an open reading frame encoding 360 amino acid polypeptide, as in SEQ ID NO. 45, with a calculated molecular mass of about 39 kD. Bioinformatic analysis of SEQ ID NO. 44 reveals that this sequence produces β-1,4-endoglucanase protein that specifically cleaves the internal bonds of the cellulose chain.

In another embodiment, the 1395 bp long polynucleotide illustrated in SEQ ID NO. 47 is the full length cDNA clone encoding β-1,4-endoglucanase protein exhibiting an open reading frame encoding a 464 amino acid polypeptide, as in SEQ ID NO. 48, with a calculated molecular mass of about 47.68 kD. Bioinformatic analysis of SEQ ID NO. 47 reveals that this sequence produces β-1,4-endoglucanase protein that specifically cleaves the internal bonds of the cellulose chain.

In another embodiment, the 1368 bp long polynucleotide illustrated in SEQ ID NO. 50 is the full length cDNA clone encoding cellobiohyrolase protein exhibiting an open reading frame encoding 455 amino acid polypeptide, as in SEQ ID NO. 51, with a calculated molecular mass of about 48 kD. Bioinformatic analysis of SEQ ID NO. 50 reveal that this sequence produces cellobiohyrolase protein that attack cellulose either from the reducing or the non-reducing ends of the cellulose polymer and produces a glucose dimer, cellobiose.

In another embodiment, the 1392 bp long polynucleotide illustrated in SEQ ID NO. 53 is the full length cDNA clone encoding cellobiohyrolase protein exhibiting an open reading frame encoding 463 amino acid polypeptide, as in SEQ ID NO. 54, with a calculated molecular mass of about 50 kD. Bioinformatic analysis of SEQ ID NO. 53 reveals that this sequence produces cellobiohyrolase protein that attack cellulose either from the reducing or the non-reducing ends of the cellulose polymer and produces a glucose dimer, cellobiose.

In another embodiment, the 528 bp long polynucleotide illustrated in SEQ ID NO. 56 is the full length cDNA clone encoding cellobiohyrolase protein exhibiting an open reading frame encoding 175 amino acid polypeptide, as in SEQ ID NO. 57, with a calculated molecular mass of about 19 kD. Bioinformatic analysis of SEQ ID NO. 56 reveals that this sequence produces cellobiohyrolase protein that attack cellulose either from the reducing or the non-reducing ends of the cellulose polymer and produces a glucose dimer, cellobiose.

In another embodiment, the 2448 bp long polynucleotide illustrated in SEQ ID NO. 59 is the full length cDNA clone encoding β-glucosidase protein exhibiting an open reading frame encoding 815 amino acid polypeptide, as in SEQ ID NO. 60, with a calculated molecular mass of about 87 kD. Bioinformatic analysis of SEQ ID NO. 59 reveals that this sequence produces β-glucosidase protein that hydrolyzes the cellobiose and in some cases the cellooligosaccharides to glucose.

In another embodiment, the 2511 bp long polynucleotide illustrated in SEQ ID NO. 62 is the full length cDNA clone encoding β-glucosidase protein exhibiting an open reading frame encoding 836 amino acid polypeptide, as in SEQ ID NO. 63, with a calculated molecular mass of about 90 kD. Bioinformatic analysis of SEQ ID NO. 62 reveals that this sequence produces β-glucosidase protein that hydrolyzes the cellobiose and in some cases the cellooligosaccharides to glucose.

In another embodiment, the 2202 bp long polynucleotide illustrated in SEQ ID NO. 65 is the full length cDNA clone encoding β-glucosidase protein exhibiting an open reading frame encoding 733 amino acid polypeptide, as in SEQ ID NO. 66, with a calculated molecular mass of about 77 kD. Bioinformatic analysis of SEQ ID NO. 65 reveals that this sequence produces β-glucosidase protein that hydrolyzes the cellobiose and in some cases the cellooligosaccharides to glucose.

In another embodiment, the 2712 bp long polynucleotide illustrated in SEQ ID NO. 68 is the full length cDNA clone encoding β-glucosidase protein exhibiting an open reading frame encoding 903 amino acid polypeptide, as in SEQ ID NO. 69, with a calculated molecular mass of about 96 kD. Bioinformatic analysis of SEQ ID NO. 68 reveals that this sequence produces β-glucosidase protein that hydrolyzes the cellobiose and in some cases the cellooligosaccharides to glucose.

In another embodiment, the 3249 bp long polynucleotide illustrated in SEQ ID NO. 71 is the full length cDNA clone encoding β-glucosidase protein exhibiting an open reading frame encoding 1082 amino acid polypeptide, as in SEQ ID NO. 72, with a calculated molecular mass of about 119 kD. Bioinformatic analysis of SEQ ID NO. 71 reveal that this sequence produces β-glucosidase protein that hydrolyzes the cellobiose and in some cases the cellooligosaccharides to glucose.

In another embodiment, the 2616 bp long polynucleotide illustrated in SEQ ID NO. 74 is the full length cDNA clone encoding β-glucosidase protein exhibiting an open reading frame encoding 871 amino acid polypeptide, as in SEQ ID NO. 75, with a calculated molecular mass of about 93 kD. Bioinformatic analysis of SEQ ID NO. 74 reveal that this sequence produces β-glucosidase protein that hydrolyzes the cellobiose and in some cases the cellooligosaccharides to glucose.

In another embodiment, the 2418 bp long polynucleotide illustrated in SEQ ID NO. 77 is the full length cDNA clone encoding β-glucosidase protein exhibiting an open reading frame encoding 805 amino acid polypeptide, as in SEQ ID NO. 78 with a calculated molecular mass of about 84 kD.

Bioinformatic analysis of SEQ ID NO. 77 reveals that this sequence produces β-glucosidase protein that hydrolyzes the cellobiose and in some cases the cellooligosaccharides to glucose.

In another embodiment, the 2346 bp long polynucleotide illustrated in SEQ ID NO. 80 is the full length cDNA clone encoding β-glucosidase protein exhibiting an open reading frame encoding 781 amino acid polypeptide, as in SEQ ID NO. 81 with a calculated molecular mass of about 84 kD. Bioinformatic analysis of SEQ ID NO. 80 reveals that this sequence produces β-glucosidase protein that hydrolyzes the cellobiose and in some cases the cellooligosaccharides to glucose.

In another embodiment, the 2499 bp long polynucleotide illustrated in SEQ ID NO. 83 is the full length cDNA clone encoding β-glucosidase protein exhibiting an open reading frame encoding 832 amino acid polypeptide, as in SEQ ID NO. 84 with a calculated molecular mass of about 91 kD. Bioinformatic analysis of SEQ ID NO. 83 reveals that this sequence produces β-glucosidase protein that hydrolyzes the cellobiose and in some cases the cellooligosaccharides to glucose.

In another embodiment, the 2337 bp long polynucleotide illustrated in SEQ ID NO. 86 is the full length cDNA clone encoding β-glucosidase protein exhibiting an open reading frame encoding 778 amino acid polypeptide, as in SEQ ID NO. 87 with a calculated molecular mass of about 84 kD. Bioinformatic analysis of SEQ ID NO. 86 reveals that this sequence produces β-glucosidase protein that hydrolyzes the cellobiose and in some cases the cellooligosaccharides to glucose.

In another embodiment, the 2361 bp long polynucleotide illustrated in SEQ ID NO. 89 is the full length cDNA clone encoding β-glucosidase protein exhibiting an open reading frame encoding 786 amino acid polypeptide, as in SEQ ID NO. 90 with a calculated molecular mass of about 85 kD. Bioinformatic analysis of SEQ ID NO. 89 reveals that this sequence produces β-glucosidase protein that hydrolyzes the cellobiose and in some cases the cellooligosaccharides to glucose.

In another embodiment, the 1905 bp long polynucleotide illustrated in SEQ ID NO. 92 is the full length cDNA clone encoding β-glucosidase protein exhibiting an open reading frame encoding 634 amino acid polypeptide, as in SEQ ID NO. 93 with a calculated molecular mass of about 70 kD. Bioinformatic analysis of SEQ ID NO. 92 reveals that this sequence produces β-glucosidase protein that hydrolyzes the cellobiose and in some cases the cellooligosaccharides to glucose.

In another embodiment, the 1731 bp long polynucleotide illustrated in SEQ ID NO. 95 is the full length cDNA clone encoding β-glucosidase protein exhibiting an open reading frame encoding 576 amino acid polypeptide, as in SEQ ID NO. 96 with a calculated molecular mass of about 65 kD. Bioinformatic analysis of SEQ ID NO. 95 reveals that this sequence produces β-glucosidase protein that hydrolyzes the cellobiose and in some cases the cellooligosaccharides to glucose.

In another embodiment, the 1443 bp long polynucleotide illustrated in SEQ ID NO. 98 is the full length cDNA clone encoding β-glucosidase protein exhibiting an open reading frame encoding 480 amino acid polypeptide, as in SEQ ID NO. 99 with a calculated molecular mass of about 55 kD. Bioinformatic analysis of SEQ ID NO. 98 reveals that this sequence produces β-glucosidase protein that hydrolyzes the cellobiose and in some cases the cellooligosaccharides to glucose.

In another embodiment, the 1617 bp long polynucleotide illustrated in SEQ ID NO. 101 is the full length cDNA clone encoding β-glucosidase protein exhibiting an open reading frame encoding 538 amino acid polypeptide, as in SEQ ID NO. 102 with a calculated molecular mass of about 61 kD. Bioinformatic analysis of SEQ ID NO. 101 reveals that this sequence produces β-glucosidase protein that hydrolyzes the cellobiose and in some cases the cellooligosaccharides to glucose.

In another embodiment, the 1863 bp long polynucleotide illustrated in SEQ ID NO. 104 is the full length cDNA clone encoding β-glucosidase protein exhibiting an open reading frame encoding 620 amino acid polypeptide, as in SEQ ID NO. 105 with a calculated molecular mass of about 69 kD. Bioinformatic analysis of SEQ ID NO. 104 reveals that this sequence produces β-glucosidase protein that hydrolyzes the cellobiose and in some cases the cellooligosaccharides to glucose.

In another embodiment, the 1629 bp long polynucleotide illustrated in SEQ ID NO. 107 is the full length cDNA clone encoding β-glucosidase protein exhibiting an open reading frame encoding 542 amino acid polypeptide, as in SEQ ID NO. 108 with a calculated molecular mass of about 61 kD. Bioinformatic analysis of SEQ ID NO. 107 reveals that this sequence produces β-glucosidase protein that hydrolyzes the cellobiose and in some cases the cellooligosaccharides to glucose.

In another embodiment, the 654 bp long polynucleotide illustrated in SEQ ID NO. 110 is the full length cDNA clone encoding β-glucosidase protein exhibiting an open reading frame encoding 217 amino acid polypeptide, as in SEQ ID NO. 111 with a calculated molecular mass of about 25 kD. Bioinformatic analysis of SEQ ID NO. 110 reveals that this sequence produces β-glucosidase protein that hydrolyzes the cellobiose and in some cases the cellooligosaccharides to glucose.

In another embodiment, the 2406 bp long polynucleotide illustrated in SEQ ID NO. 113 is the full length cDNA clone encoding β-glucosidase protein exhibiting an open reading frame encoding 801 amino acid polypeptide, as in SEQ ID NO. 114 with a calculated molecular mass of about 77 kD. Bioinformatic analysis of SEQ ID NO. 113 reveals that this sequence produces β-glucosidase protein that hydrolyzes the cellobiose and in some cases the cellooligosaccharides to glucose.

In another embodiment, the 2214 bp long polynucleotide illustrated in SEQ ID NO. 116 is the full length cDNA clone encoding β-glucosidase protein exhibiting an open reading frame encoding 737 amino acid polypeptide, as in SEQ ID NO. 117 with a calculated molecular mass of about 78 kD. Bioinformatic analysis of SEQ ID NO. 116 reveals that this sequence produces β-glucosidase protein that hydrolyzes the cellobiose and in some cases the cellooligosaccharides to glucose.

In another embodiment, the 2664 bp long polynucleotide illustrated in SEQ ID NO. 119 is the full length cDNA clone encoding α-glucosidase protein exhibiting an open reading frame encoding 887 amino acid polypeptide, as in SEQ ID NO. 120 with a calculated molecular mass of about 97 kD. Bioinformatic analysis of SEQ ID NO. 119 reveals that this sequence produces α-glucosidase protein that hydrolyzes the terminal, non-reducing (1→4)-linked α-D-glucose residues into release of α-D-glucose.

In another embodiment, the 2172 bp long polynucleotide illustrated in SEQ ID NO. 122 is the full length cDNA clone encoding α-glucosidase protein exhibiting an open reading frame encoding 723 amino acid polypeptide, as in SEQ ID NO. 123 with a calculated molecular mass of about 80 kD. Bioinformatic analysis of SEQ ID NO. 122 reveals that this sequence produces α-glucosidase protein that hydrolyzes the terminal, non-reducing (1→4)-linked α-D-glucose residues into release of α-D-glucose.

In another embodiment, the 2226 bp long polynucleotide illustrated in SEQ ID NO. 125 is the full length cDNA clone encoding α-glucosidase protein exhibiting an open reading frame encoding 741 amino acid polypeptide, as in SEQ ID NO. 126 with a calculated molecular mass of about 83 kD. Bioinformatic analysis of SEQ ID NO. 125 reveals that this sequence produces α-glucosidase protein that hydrolyzes the terminal, non-reducing (1→4)-linked α-D-glucose residues with release of α-D-glucose.

In another embodiment, the 2967 bp long polynucleotide illustrated in SEQ ID NO. 128 is the full length cDNA clone encoding α-glucosidase protein exhibiting an open reading frame encoding 988 amino acid polypeptide, as in SEQ ID NO. 129 with a calculated molecular mass of about 112 kD. Bioinformatic analysis of SEQ ID NO. 128 reveals that this sequence produces α-glucosidase protein that hydrolyzes the terminal, non-reducing (1→4)-linked α-D-glucose residues with release of α-D-glucose.

In another embodiment, the 3024 bp long polynucleotide illustrated in SEQ ID NO. 131 is the full length cDNA clone encoding α-glucosidase protein exhibiting an open reading frame encoding 1007 amino acid polypeptide, as in SEQ ID NO. 132 with a calculated molecular mass of about 110 kD. Bioinformatic analysis of SEQ ID NO. 131 reveals that this sequence produces α-glucosidase protein that hydrolyzes the terminal, non-reducing (1→4)-linked α-D-glucose residues with release of α-D-glucose.

In another embodiment, the 2544 bp long polynucleotide illustrated in SEQ ID NO. 134 is the full length cDNA clone encoding α-glucosidase protein exhibiting an open reading frame encoding 847 amino acid polypeptide, as in SEQ ID NO. 135 with a calculated molecular mass of about 94 kD. Bioinformatic analysis of SEQ ID NO. 134 reveals that this sequence produces α-glucosidase protein that hydrolyzes the terminal, non-reducing (1→4)-linked α-D-glucose residues with release of α-D-glucose.

In another embodiment, the 1359 bp long polynucleotide illustrated in SEQ ID NO. 137 is the full length cDNA clone encoding α-glucosidase protein exhibiting an open reading frame encoding 452 amino acid polypeptide, as in SEQ ID NO. 138 with a calculated molecular mass of about 50 kD. Bioinformatic analysis of SEQ ID NO. 137 reveals that this sequence produces α-glucosidase protein that hydrolyzes the terminal, non-reducing (1→4)-linked α-D-glucose residues with release of α-D-glucose.

In another embodiment, the 1734 bp long polynucleotide illustrated in SEQ ID NO. 140 is the full length cDNA clone encoding exo-1,3-β-glucanase protein exhibiting an open reading frame encoding 577 amino acid polypeptide, as in SEQ ID NO. 141 with a calculated molecular mass of about 63 kD. Bioinformatic analysis of SEQ ID NO. 140 reveals that this sequence produces exo-1,3-β-glucanase protein that successively hydrolyses of β-D-glucose units from the non-reducing ends of (1→3)-β-D-glucans, releasing α-glucose.

In another embodiment, the 1341 bp long polynucleotide illustrated in SEQ ID NO. 143 is the full length cDNA clone encoding exo-1,3-β-glucanase protein exhibiting an open reading frame encoding a 446 amino acid polypeptide, as in SEQ ID NO. 144 with a calculated molecular mass of about 49 kD. Bioinformatic analysis of SEQ ID NO. 143 reveals that this sequence produces exo-1,3-β-glucanase protein that successively hydrolyses of β-D-glucose units from the non-reducing ends of (1→3)-β-D-glucans, releasing α-glucose.

In another embodiment, the 1251 bp long polynucleotide illustrated in SEQ ID NO. 146 is the full length cDNA clone encoding exo-1,3-β-glucanase protein exhibiting an open reading frame encoding 416 amino acid polypeptide, as in SEQ ID NO. 147 with a calculated molecular mass of about 46 kD. Bioinformatic analysis of SEQ ID NO. 146 reveals that this sequence produces exo-1,3-β-glucanase protein that successively hydrolyses of β-D-glucose units from the non-reducing ends of (1→3)-β-D-glucans, releasing α-glucose.

In another embodiment, the 885 bp long polynucleotide illustrated in SEQ ID NO. 149 is the full length cDNA clone encoding glucan-1,3-β-glucanase protein exhibiting an open reading frame encoding 294 amino acid polypeptide, as in SEQ ID NO. 150 with a calculated molecular mass of about 32 kD. Bioinformatic analysis of SEQ ID NO. 149 reveals that this sequence produces glucan-1,3-β-glucanase protein that successively hydrolyses of β-D-glucose units from the non-reducing ends of (1→3)-β-D-glucans, releasing α-glucose.

In another embodiment, the 921 bp long polynucleotide illustrated in SEQ ID NO. 152 is the full length cDNA clone encoding glucan-1,3-β-glucanase protein exhibiting an open reading frame encoding 306 amino acid polypeptide, as in SEQ ID NO. 153 with a calculated molecular mass of about 33 kD. Bioinformatic analysis of SEQ ID NO. 152 reveals that this sequence produces glucan-1,3-β-glucanase protein that successively hydrolyses of β-D-glucose units from the non-reducing ends of (1→3)-β-D-glucans, releasing α-glucose.

In another embodiment, the 1242 bp long polynucleotide illustrated in SEQ ID NO. 155 is the full length cDNA clone encoding exo-1,3-βeta-glucanase protein exhibiting an open reading frame encoding a 413 amino acid polypeptide, as in SEQ ID NO. 156 with a calculated molecular mass of about 46 kD. Bioinformatic analysis of SEQ ID NO. 155 reveals that this sequence produces exo-1,3-β-glucanase protein that successively hydrolyses of β-D-glucose units from the non-reducing ends of (1→3)-β-D-glucans, releasing α-glucose.

In another embodiment, the 2757 bp long polynucleotide illustrated in SEQ ID NO. 158 is the full length cDNA clone encoding exo-1,3-β-glucanase protein exhibiting an open reading frame encoding 918 amino acid polypeptide, as in SEQ ID NO. 159 with a calculated molecular mass of about 105 kD. Bioinformatic analysis of SEQ ID NO. 158 reveals that this sequence produces exo-1,3-β-glucanase protein that successively hydrolyses of β-D-glucose units from the non-reducing ends of (1→3)-β-D-glucans, releasing α-glucose.

In another embodiment, the 2334 bp long polynucleotide illustrated in SEQ ID NO. 161 is the full length cDNA clone encoding exo-1,3-β-glucanase protein exhibiting an open reading frame encoding 777 amino acid polypeptide, as in SEQ ID NO. 162 with a calculated molecular mass of about 86 kD. Bioinformatic analysis of SEQ ID NO. 161 reveals that this sequence produces exo-1,3-β-glucanase protein that successively hydrolyses of β-D-glucose units from the non-reducing ends of (1→3)-β-D-glucans, releasing α-glucose.

In another embodiment, the 2529 bp long polynucleotide illustrated in SEQ ID NO. 164 is the full length cDNA clone encoding exo-1,3-β-glucanase protein exhibiting an open reading frame encoding 842 amino acid polypeptide, as in SEQ ID NO. 165 with a calculated molecular mass of about 91 kD. Bioinformatic analysis of SEQ ID NO. 164 reveals that this sequence produces exo-1,3-β-glucanase protein that successively hydrolyses of β-D-glucose units from the non-reducing ends of (1→3)-β-D-glucans, releasing α-glucose.

In another embodiment, the 3363 bp long polynucleotide illustrated in SEQ ID NO. 167 is the full length cDNA clone encoding α-1,4-glucan lyase protein exhibiting an open reading frame encoding 1120 amino acid polypeptide, as in SEQ ID NO. 168 with a calculated molecular mass of about 127 kD. Bioinformatic analysis of SEQ ID NO. 167 reveals that this sequence produces α-1,4-glucan lyase protein that catalyzes the sequential degradation of (1→4)-α-D-glucans from the non-reducing end with the release of 1,5-anhydro-D-fructose and D-glucose.

In another embodiment, the 3345 bp long polynucleotide illustrated in SEQ ID NO. 170 is the full length cDNA clone encoding α-1,4-glucan lyase protein exhibiting an open reading frame encoding 1114 amino acid polypeptide, as in SEQ ID NO. 171 with a calculated molecular mass of about 128 kD. Bioinformatic analysis of SEQ ID NO. 170 reveals that this sequence produces α-1,4-glucan lyase protein that catalyzes the sequential degradation of (1→4)-α-D-glucans from the non-reducing end with the release of 1,5-anhydro-D-fructose and D-glucose.

In another embodiment, the 2025 bp long polynucleotide illustrated in SEQ ID NO. 173 is the full length cDNA clone encoding α-xylosidase protein exhibiting an open reading frame encoding a 674 amino acid polypeptide, as in SEQ ID NO. 174 with a calculated molecular mass of about 76 kD. Bioinformatic analysis of SEQ ID NO. 173 reveals that this sequence produces α-xylosidase protein that catalyzes, the hydrolysis of xyloglucan side chains and remove unsubstituted D-xylose residues attached to the glucose located at the non-reducing terminus. This enzyme involve in the degradation of xyloglucan oligosaccharides.

In another embodiment, the 2316 bp long polynucleotide illustrated in SEQ ID NO. 176 is the full length cDNA clone encoding α-xylosidase protein exhibiting an open reading frame encoding 771 amino acid polypeptide, as in SEQ ID NO. 177 with a calculated molecular mass of about 86 kD. Bioinformatic analysis of SEQ ID NO. 176 reveals that this sequence produces α-xylosidase protein that catalyzes, the hydrolysis of xyloglucan side chains and remove unsubstituted D-xylose residues attached to the glucose located at the non-reducing terminus. This enzyme involve in the degradation of xyloglucan oligosaccharides.

In another embodiment, the 1236 bp long polynucleotide illustrated in SEQ ID NO. 179 is the full length cDNA clone encoding d-4,5-unsaturated β-glucuronyl hydrolase protein exhibiting an open reading frame encoding 411 amino acid polypeptide, as in SEQ ID NO. 180 with a calculated molecular mass of about 45 kD. Bioinformatic analysis of SEQ ID NO. 179 reveals that this sequence produces d-4,5-unsaturated β-glucuronyl hydrolase protein that catalyses the hydrolytic release of unsaturated glucuronic acids from oligosaccharides produced by the reactions of polysaccharide lyases.

In another embodiment, the 1143 bp long polynucleotide illustrated in SEQ ID NO. 182 is the full length cDNA clone encoding d-4,5-unsaturated β-glucuronyl hydrolase protein exhibiting an open reading frame encoding 380 amino acid polypeptide, as in SEQ ID NO. 183 with a calculated molecular mass of about 44 kD. Bioinformatic analysis of SEQ ID NO. 182 reveals that this sequence produces d-4,5-unsaturated β-glucuronyl hydrolase protein that catalyses the hydrolytic release of unsaturated glucuronic acids from oligosaccharides produced by the reactions of polysaccharide lyases.

In another embodiment, the 1248 bp long polynucleotide illustrated in SEQ ID NO. 185 is the full length cDNA clone encoding d-4,5-unsaturated β-glucuronyl hydrolase protein exhibiting an open reading frame encoding 415 amino acid polypeptide, as in SEQ ID NO. 186 with a calculated molecular mass of about 47 kD. Bioinformatic analysis of SEQ ID NO. 185 reveals that this sequence produces d-4,5-unsaturated β-glucuronyl hydrolase protein that catalyses the hydrolytic release of unsaturated glucuronic acids from oligosaccharides produced by the reactions of polysaccharide lyases.

In another embodiment, the 1158 bp long polynucleotide illustrated in SEQ ID NO. 188 is the full length cDNA clone encoding d-4,5-unsaturated β-glucuronyl hydrolase protein exhibiting an open reading frame encoding 385 amino acid polypeptide, as in SEQ ID NO. 189 with a calculated molecular mass of about 43 kD. Bioinformatic analysis of SEQ ID NO. 188 reveals that this sequence produces d-4,5-unsaturated β-glucuronyl hydrolase protein that catalyses the hydrolytic release of unsaturated glucuronic acids from oligosaccharides produced by the reactions of polysaccharide lyases.

In another embodiment, the 1113 bp long polynucleotide illustrated in SEQ ID NO. 191 is the full length cDNA clone encoding d-4,5-unsaturated β-glucuronyl hydrolase protein exhibiting an open reading frame encoding 370 amino acid polypeptide, as in SEQ ID NO. 192 with a calculated molecular mass of about 39 kD. Bioinformatic analysis of SEQ ID NO. 191 reveals that this sequence produces d-4,5-unsaturated β-glucuronyl hydrolase protein that catalyses the hydrolytic release of unsaturated glucuronic acids from oligosaccharides produced by the reactions of polysaccharide lyases.

In another embodiment, the 1683 bp long polynucleotide illustrated in SEQ ID NO. 194 is the full length cDNA clone encoding glucan 1,4-α-glucosidase protein exhibiting an open reading frame encoding 560 amino acid polypeptide, as in SEQ ID NO. 195 with a calculated molecular mass of about 61 kD. Bioinformatic analysis of SEQ ID NO. 194 reveals that this sequence produces glucan 1,4-α-glucosidase protein that hydrolyze of terminal (1→4)-linked α-D-glucose residues successively from non-reducing ends of the chains with release of β-D-glucose.

In another embodiment, the 1917 bp long polynucleotide illustrated in SEQ ID NO. 197 is the full length cDNA clone encoding glucan 1,4-α-glucosidase protein exhibiting an open reading frame encoding 638 amino acid polypeptide, as in SEQ ID NO. 198 with a calculated molecular mass of about 68 kD. Bioinformatic analysis of SEQ ID NO. 197 reveals that this sequence produces glucan 1,4-α-glucosidase protein that hydrolyzes the terminal (1→4)-linked α-D-glucose residues successively from non-reducing ends of the chains with release of β-D-glucose.

In another embodiment, the 2670 bp long polynucleotide illustrated in SEQ ID NO. 200 is the full length cDNA clone encoding α-1,2-mannosidase protein exhibiting an open reading frame encoding 889 amino acid polypeptide, as in SEQ ID NO. 201 with a calculated molecular mass of about 95 kD. Bioinformatic analysis of SEQ ID NO. 200 reveals that this sequence produces α-1,2-mannosidase protein that removes α-1,2-linked mannose residues from Man(9)(GlcNAc)(2) by hydrolysis.

In another embodiment, the 2361 bp long polynucleotide illustrated in SEQ ID NO. 203 is the full length cDNA clone encoding α-1,2-mannosidase protein exhibiting an open reading frame encoding 786 amino acid polypeptide, as in SEQ ID NO. 204 with a calculated molecular mass of about 85 kD. Bioinformatic analysis of SEQ ID NO. 203 reveals that this sequence produces α-1,2-mannosidase protein that removes α-1,2-linked mannose residues from Man(9)(GlcNAc)(2) by hydrolysis.

In another embodiment, the 2382 bp long polynucleotide illustrated in SEQ ID NO. 206 is the full length cDNA clone encoding α-1,2-mannosidase protein exhibiting an open reading frame encoding 793 amino acid polypeptide, as in SEQ ID NO. 207 with a calculated molecular mass of about 88 kD. Bioinformatic analysis of SEQ ID NO. 206 reveals that this sequence produces α-1,2-mannosidase protein that removes α-1,2-linked mannose residues from Man(9)(GlcNAc)(2) by hydrolysis.

In another embodiment, the 2415 bp long polynucleotide illustrated in SEQ ID NO. 209 is the full length cDNA clone encoding α-1,2-mannosidase protein exhibiting an open reading frame encoding 804 amino acid polypeptide, as in SEQ ID NO. 210 with a calculated molecular mass of about 88 kD. Bioinformatic analysis of SEQ ID NO. 209 reveals that this sequence produces α-1,2-mannosidase protein that removes α-1,2-linked mannose residues from Man(9)(GlcNAc)(2) by hydrolysis.

In another embodiment, the 2289 bp long polynucleotide illustrated in SEQ ID NO. 212 is the full length cDNA clone encoding α-1,2-mannosidase protein exhibiting an open reading frame encoding a 762 amino acid polypeptide, as in SEQ ID NO. 213 with a calculated molecular mass of about 83 kD. Bioinformatic analysis of SEQ ID NO. 212 reveals that this sequence produces α-1,2-mannosidase protein that removes α-1,2-linked mannose residues from Man(9)(GlcNAc)(2) by hydrolysis.

In another embodiment, the 2484 bp long polynucleotide illustrated in SEQ ID NO. 215 is the full length cDNA clone encoding α-1,2-mannosidase protein exhibiting an open reading frame encoding a 827 amino acid polypeptide, as in SEQ ID NO. 216 with a calculated molecular mass of about 92 kD. Bioinformatic analysis of SEQ ID NO. 215 reveals that this sequence produces α-1,2-mannosidase protein that removes α-1,2-linked mannose residues from Man(9)(GlcNAc)(2) by hydrolysis.

In another embodiment, the 1485 bp long polynucleotide illustrated in SEQ ID NO. 218 is the full length cDNA clone encoding α-1,3-glucanase protein exhibiting an open reading frame encoding 494 amino acid polypeptide, as in SEQ ID NO. 219 with a calculated molecular mass of about 52 kD. Bioinformatic analysis of SEQ ID NO. 218 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1533 bp long polynucleotide illustrated in SEQ ID NO. 221 is the full length cDNA clone encoding α-1,3-glucanase protein exhibiting an open reading frame encoding 510 amino acid polypeptide, as in SEQ ID NO. 222 with a calculated molecular mass of about 56 kD. Bioinformatic analysis of SEQ ID NO. 221 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1344 bp long polynucleotide illustrated in SEQ ID NO. 224 is the full length cDNA clone encoding α-1,3-glucanase protein exhibiting an open reading frame encoding 447 amino acid polypeptide, as in SEQ ID NO. 225 with a calculated molecular mass of about 49 kD. Bioinformatic analysis of SEQ ID NO. 224 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1365 bp long polynucleotide illustrated in SEQ ID NO. 227 is the full length cDNA clone encoding α-1,3-glucanase protein exhibiting an open reading frame encoding a 454 amino acid polypeptide, as in SEQ ID NO. 228 with a calculated molecular mass of about 49 kD. Bioinformatic analysis of SEQ ID NO. 227 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 765 bp long polynucleotide illustrated in SEQ ID NO. 230 is the full length cDNA clone encoding α-1,3-glucanase protein exhibiting an open reading frame encoding a 254 amino acid polypeptide, as in SEQ ID NO. 231 with a calculated molecular mass of about 29 kD. Bioinformatic analysis of SEQ ID NO. 230 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1485 bp long polynucleotide illustrated in SEQ ID NO. 233 is the full length cDNA clone encoding α-1,3-glucanase protein exhibiting an open reading frame encoding 494 amino acid polypeptide, as in SEQ ID NO. 234 with a calculated molecular mass of about 55 kD. Bioinformatic analysis of SEQ ID NO. 233 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1503 bp long polynucleotide illustrated in SEQ ID NO. 236 is the full length cDNA clone encoding α-1,3-glucanase protein exhibiting an open reading frame encoding 500 amino acid polypeptide, as in SEQ ID NO. 237 with a calculated molecular mass of about 54 kD. Bioinformatic analysis of SEQ ID NO. 236 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 810 bp long polynucleotide illustrated in SEQ ID NO. 239 is the full length cDNA clone encoding α-1,3-glucanase protein exhibiting an open reading frame encoding 269 amino acid polypeptide, as in SEQ ID NO. 240 with a calculated molecular mass of about 29 kD. Bioinformatic analysis of SEQ ID NO. 239 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 783 bp long polynucleotide illustrated in SEQ ID NO. 242 is the full length cDNA clone encoding α-1,3-glucanase protein exhibiting an open reading frame encoding 260 amino acid polypeptide, as in SEQ ID NO. 243 with a calculated molecular mass of about 29 kD. Bioinformatic analysis of SEQ ID NO. 242 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1251 bp long polynucleotide illustrated in SEQ ID NO. 245 is the full length cDNA clone encoding α-1,3-glucanase protein exhibiting an open reading frame encoding 416 amino acid polypeptide, as in SEQ ID NO. 246 with a calculated molecular mass of about 45 kD. Bioinformatic analysis of SEQ ID NO. 245 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1350 bp long polynucleotide illustrated in SEQ ID NO. 248 is the full length cDNA clone encoding α-1,3-glucanase protein exhibiting an open reading frame encoding 449 amino acid polypeptide, as in SEQ ID NO. 249 with a calculated molecular mass of about 50 kD. Bioinformatic analysis of SEQ ID NO. 248 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 1485 bp long polynucleotide illustrated in SEQ ID NO. 251 is the full length cDNA clone encoding α-1,3-glucanase protein exhibiting an open reading frame encoding 494 amino acid polypeptide, as in SEQ ID NO. 252 with a calculated molecular mass of about 55 kD. Bioinformatic analysis of SEQ ID NO. 251 reveals that this sequence produces α-1,3-glucanase protein that degrades α-1,3-glucans and also has ability to remove dental plaques. Therefore, this enzyme could be applied as active ingredients in mouthwash, toothpaste, dental gel or chewing gum to prevent the accumulation of glucose biopolymers and might also be useful in all other forms of preventive oral hygiene.

In another embodiment, the 2349 bp long polynucleotide illustrated in SEQ ID NO. 254 is the full length cDNA clone encoding α-L-fucosidase protein exhibiting an open reading frame encoding 782 amino acid polypeptide, as in SEQ ID NO. 255 with a calculated molecular mass of about 86 kD. Bioinformatic analysis of SEQ ID NO. 254 reveals that this sequence produces α-L-fucosidase protein which is responsible for hydrolysing the α-1,6-linked fucose joined to the reducing-end N-acetylglucosamine of the carbohydrate moieties of glycoproteins. Therefore, this α-L-fucosidase is involved in degradation of fucosylated xyloglucans.

In another embodiment, the 2208 bp long polynucleotide illustrated in SEQ ID NO. 257 is the full length cDNA clone encoding α-L-fucosidase protein exhibiting an open reading frame encoding 735 amino acid polypeptide, as in SEQ ID NO. 258 with a calculated molecular mass of about 81 kD. Bioinformatic analysis of SEQ ID NO. 257 reveals that this sequence produces α-L-fucosidase protein which is responsible for hydrolysing the α-1,6-linked fucose joined to the reducing-end N-acetylglucosamine of the carbohydrate moieties of glycoproteins. Therefore, this α-L-fucosidase is involved in degradation of fucosylated xyloglucans.

In another embodiment, the 1491 bp long polynucleotide illustrated in SEQ ID NO. 260 is the full length cDNA clone encoding β-1,4-xylosidase protein exhibiting an open reading frame encoding 496 amino acid polypeptide, as in SEQ ID NO. 261 with a calculated molecular mass of about 56 kD. Bioinformatic analysis of SEQ ID NO. 260 reveals that this sequence produces β-1,4-xylosidase protein that hydrolyses the (1→4)-β-D-xylans, to remove successive D-xylose residues from the non-reducing termini.

In another embodiment, the 1548 bp long polynucleotide illustrated in SEQ ID NO. 263 is the full length cDNA clone encoding β-1,4-xylosidase protein exhibiting an open reading frame encoding 515 amino acid polypeptide, as in SEQ ID NO. 264 with a calculated molecular mass of about 56 kD. Bioinformatic analysis of SEQ ID NO. 263 reveals that this sequence produces β-1,4-xylosidase protein that hydrolyses the (1→4)-β-D-xylans, to remove successive D-xylose residues from the non-reducing termini.

In another embodiment, the 1560 bp long polynucleotide illustrated in SEQ ID NO. 266 is the full length cDNA clone encoding β-1,4-xylosidase protein exhibiting an open reading frame encoding 519 amino acid polypeptide, as in SEQ ID NO. 267 with a calculated molecular mass of about 56 kD. Bioinformatic analysis of SEQ ID NO. 266 reveals that this sequence produces β-1,4-xylosidase protein that hydrolyses the (1→4)-β-D-xylans, to remove successive D-xylose residues from the non-reducing termini.

In another embodiment, the 2403 bp long polynucleotide illustrated in SEQ ID NO. 269 is the full length cDNA clone encoding β-1,4-xylosidase protein exhibiting an open reading frame encoding 800 amino acid polypeptide, as in SEQ ID NO. 270 with a calculated molecular mass of about 87 kD. Bioinformatic analysis of SEQ ID NO. 269 reveals that this sequence produces β-1,4-xylosidase protein that hydrolyses the (1→4)-β-D-xylans, to remove successive D-xylose residues from the non-reducing termini.

In another embodiment, the 2916 bp long polynucleotide illustrated in SEQ ID NO. 272 is the full length cDNA clone encoding β-1,4-xylosidase protein exhibiting an open reading frame encoding 971 amino acid polypeptide, as in SEQ ID NO. 273 with a calculated molecular mass of about 104 kD. Bioinformatic analysis of SEQ ID NO. 272 reveals that this sequence produces β-1,4-xylosidase protein that hydrolyses the (1→4)-β-D-xylans, to remove successive D-xylose residues from the non-reducing termini.

In another embodiment, the 978 bp long polynucleotide illustrated in SEQ ID NO. 275 is the full length cDNA clone encoding β-1,4-xylosidase protein exhibiting an open reading frame encoding 325 amino acid polypeptide, as in SEQ ID NO. 276 with a calculated molecular mass of about 36 kD. Bioinformatic analysis of SEQ ID NO. 275 reveals that this sequence produces β-1,4-xylosidase protein that hydrolyses the (1→4)-β-D-xylans, to remove successive D-xylose residues from the non-reducing termini.

In another embodiment, the 1731 bp long polynucleotide illustrated in SEQ ID NO. 278 is the full length cDNA clone encoding β-1,4-xylosidase protein exhibiting an open reading frame encoding 576 amino acid polypeptide, as in SEQ ID NO. 279 with a calculated molecular mass of about 63 kD. Bioinformatic analysis of SEQ ID NO. 278 reveals that this sequence produces β-1,4-xylosidase protein that hydrolyses the (1→4)-β-D-xylans, to remove successive D-xylose residues from the non-reducing termini.

In another embodiment, the 1737 bp long polynucleotide illustrated in SEQ ID NO. 281 is the full length cDNA clone encoding β-1,4-xylosidase protein exhibiting an open reading frame encoding 578 amino acid polypeptide, as in SEQ ID NO. 282 with a calculated molecular mass of about 63 kD. Bioinformatic analysis of SEQ ID NO. 281 reveals that this sequence produces β-1,4-xylosidase protein that hydrolyses the (1→4)-β-D-xylans, to remove successive D-xylose residues from the non-reducing termini.

In another embodiment, the 1731 bp long polynucleotide illustrated in SEQ ID NO. 284 is the full length cDNA clone encoding β-1,4-xylosidase protein exhibiting an open reading frame encoding 576 amino acid polypeptide, as in SEQ ID NO. 285 with a calculated molecular mass of about 64 kD. Bioinformatic analysis of SEQ ID NO. 284 reveals that this sequence produces β-1,4-xylosidase protein that hydrolyses the (1→4)-β-D-xylans, to remove successive D-xylose residues from the non-reducing termini.

In another embodiment, the 1764 bp long polynucleotide illustrated in SEQ ID NO. 287 is the full length cDNA clone encoding β-1,4-xylosidase protein exhibiting an open reading frame encoding 587 amino acid polypeptide, as in SEQ ID NO. 288 with a calculated molecular mass of about 64 kD. Bioinformatic analysis of SEQ ID NO. 287 reveals that this sequence produces β-1,4-xylosidase protein that hydrolyses the (1→4)-β-D-xylans, to remove successive D-xylose residues from the non-reducing termini.

In another embodiment, the 1623 bp long polynucleotide illustrated in SEQ ID NO. 290 is the full length cDNA clone encoding β-1,4-xylosidase protein exhibiting an open reading frame encoding 540 amino acid polypeptide, as in SEQ ID NO. 291 with a calculated molecular mass of about 60 kD. Bioinformatic analysis of SEQ ID NO. 290 reveals that this sequence produces β-1,4-xylosidase protein that hydrolyses the (1→4)-β-D-xylans, to remove successive D-xylose residues from the non-reducing termini.

In another embodiment, the 960 bp long polynucleotide illustrated in SEQ ID NO. 293 is the full length cDNA clone encoding endo-1,5-α-L-arabinosidase protein exhibiting an open reading frame encoding 319 amino acid polypeptide, as in SEQ ID NO. 294 with a calculated molecular mass of about 35 kD. Bioinformatic analysis of SEQ ID NO. 293 reveals that this sequence produces endo-1,5-α-L-arabinosidase protein that catalyzes the hydrolysis of the α-1,5-linked L-arabinofuranoside backbone in (1→5)-arabinans.

In another embodiment, the 1056 bp long polynucleotide illustrated in SEQ ID NO. 296 is the full length cDNA clone encoding endo-1,5-α-L-arabinosidase protein exhibiting an open reading frame encoding 351 amino acid polypeptide, as in SEQ ID NO. 297 with a calculated molecular mass of about 38 kD. Bioinformatic analysis of SEQ ID NO. 296 reveals that this sequence produces endo-1,5-α-L-arabinosidase protein that catalyzes the hydrolysis of the α-1,5-linked L-arabinofuranoside backbone in (1→5)-arabinans.

In another embodiment, the 957 bp long polynucleotide illustrated in SEQ ID NO. 299 is the full length cDNA clone encoding endo-1,5-α-L-arabinosidase protein exhibiting an open reading frame encoding 318 amino acid polypeptide, as in SEQ ID NO. 300 with a calculated molecular mass of about 34 kD. Bioinformatic analysis of SEQ ID NO. 299 reveals that this sequence produces endo-1,5-α-L-arabinosidase protein that catalyzes the hydrolysis of the α-1,5-linked L-arabinofuranoside backbone in (1→5)-arabinans.

In another embodiment, the 1110 bp long polynucleotide illustrated in SEQ ID NO. 302 is the full length cDNA clone encoding endo-1,5-α-L-arabinosidase protein exhibiting an open reading frame encoding 369 amino acid polypeptide, as in SEQ ID NO. 303 with a calculated molecular mass of about 40 kD. Bioinformatic analysis of SEQ ID NO. 302 reveals that this sequence produces endo-1,5-α-L-arabinosidase protein that catalyzes the hydrolysis of the α-1,5-linked L-arabinofuranoside backbone in (1→5)-arabinans.

In another embodiment, the 972 bp long polynucleotide illustrated in SEQ ID NO. 305 is the full length cDNA clone encoding endo-1,4-β-xylanase protein exhibiting an open reading frame encoding 323 amino acid polypeptide, as in SEQ ID NO. 306 with a calculated molecular mass of about 34 kD. Bioinformatic analysis of SEQ ID NO. 305 reveals that this sequence produces endo-1,4-β-xylanase protein that catalyzes of the endohydrolysis of (1→4)-β-D-xylosidic linkages in xylans and produce xylose. This enzyme is crucial for depolymerization of hemicelluloses and it has a potential industrial application, such as in biobleaching, paper making and in the food and animal feed industries. Other potential applications include the conversion of xylan in wastes from agriculture and food industries into xylose, and the production of fuel and chemical feedstocks.

In another embodiment, the 987 bp long polynucleotide illustrated in SEQ ID NO. 308 is the full length cDNA clone encoding endo-1,4-β-xylanase protein exhibiting an open reading frame encoding 328 amino acid polypeptide, as in SEQ ID NO. 309 with a calculated molecular mass of about 35 kD. Bioinformatic analysis of SEQ ID NO. 308 reveals that this sequence produces endo-1,4-β-xylanase protein that catalyzes of the endohydrolysis of (1→4)-β-D-xylosidic linkages in xylans and produce xylose. This enzyme is crucial for depolymerization of hemicelluloses and it has a potential industrial application, such as in biobleaching, paper making and in the food and animal feed industries. Other potential applications include the conversion of xylan in wastes from agriculture and food industries into xylose, and the production of fuel and chemical feedstocks.

In another embodiment, the 1353 bp long polynucleotide illustrated in SEQ ID NO. 311 is the full length cDNA clone encoding endo-1,4-β-xylanase protein exhibiting an open reading frame encoding 450 amino acid polypeptide, as in SEQ ID NO. 312 with a calculated molecular mass of about 48 kD. Bioinformatic analysis of SEQ ID NO. 311 reveals that this sequence produces endo-1,4-β-xylanase protein that catalyzes of the endohydrolysis of (1→4)-β-D-xylosidic linkages in xylans and produce xylose. This enzyme is crucial for depolymerization of hemicelluloses and it has a potential industrial application, such as in biobleaching, paper making and in the food and animal feed industries. Other potential applications include the conversion of xylan in wastes from agriculture and food industries into xylose, and the production of fuel and chemical feedstocks.

In another embodiment, the 1518 bp long polynucleotide illustrated in SEQ ID NO. 314 is the full length cDNA clone encoding endo-1,4-β-xylanase protein exhibiting an open reading frame encoding a 505 amino acid polypeptide, as in SEQ ID NO. 315 with a calculated molecular mass of about 54 kD. Bioinformatic analysis of SEQ ID NO. 314 reveals that this sequence produces endo-1,4-β-xylanase protein that catalyzes of the endohydrolysis of (1→4)-β-D-xylosidic linkages in xylans and produce xylose. This enzyme is crucial for depolymerization of hemicelluloses and it has a potential industrial application, such as in biobleaching, paper making and in the food and animal feed industries. Other potential applications include the conversion of xylan in wastes from agriculture and food industries into xylose, and the production of fuel and chemical feedstocks.

In another embodiment, the 1149 bp long polynucleotide illustrated in SEQ ID NO. 317 is the full length cDNA clone encoding α-arabinofuranosidase protein exhibiting an open reading frame encoding 382 amino acid polypeptide, as in SEQ ID NO. 318 with a calculated molecular mass of about 43 kD. Bioinformatic analysis of SEQ ID NO. 317 reveals that this sequence produces α-arabinofuranosidase protein that catalyzes the hydrolysis of terminal non-reducing α-L-arabinofuranoside residues in α-L-arabinosides.

In another embodiment, the 1116 bp long polynucleotide illustrated in SEQ ID NO. 320 is the full length cDNA clone encoding α-arabinofuranosidase protein exhibiting an open reading frame encoding 371 amino acid polypeptide, as in SEQ ID NO. 321 with a calculated molecular mass of about 41 kD. Bioinformatic analysis of SEQ ID NO. 320 reveals that this sequence produces α-arabinofuranosidase protein that catalyzes the hydrolysis of terminal non-reducing α-L-arabinofuranoside residues in α-L-arabinosides.

In another embodiment, the 990 bp long polynucleotide illustrated in SEQ ID NO. 323 is the full length cDNA clone encoding α-arabinofuranosidase protein exhibiting an open reading frame encoding 329 amino acid polypeptide, as in SEQ ID NO. 324 with a calculated molecular mass of about 36 kD. Bioinformatic analysis of SEQ ID NO. 323 reveals that this sequence produces α-arabinofuranosidase protein that catalyzes the hydrolysis of terminal non-reducing α-L-arabinofuranoside residues in α-L-arabinosides.

In another embodiment, the 1002 bp long polynucleotide illustrated in SEQ ID NO. 326 is the full length cDNA clone encoding α-arabinofuranosidase protein exhibiting an open reading frame encoding 333 amino acid polypeptide, as in SEQ ID NO. 327 with a calculated molecular mass of about 36 kD. Bioinformatic analysis of SEQ ID NO. 326 reveals that this sequence produces α-arabinofuranosidase protein that catalyzes the hydrolysis of terminal non-reducing α-L-arabinofuranoside residues in α-L-arabinosides.

In another embodiment, the 1527 bp long polynucleotide illustrated in SEQ ID NO. 329 is the full length cDNA clone encoding α-arabinofuranosidase protein exhibiting an open reading frame encoding 508 amino acid polypeptide, as in SEQ ID NO. 330 with a calculated molecular mass of about 57 kD. Bioinformatic analysis of SEQ ID NO. 329 reveals that this sequence produces α-arabinofuranosidase protein that catalyzes the hydrolysis of terminal non-reducing α-L-arabinofuranoside residues in α-L-arabinosides.

In another embodiment, the 2145 bp long polynucleotide illustrated in SEQ ID NO. 332 is the full length cDNA clone encoding α-arabinofuranosidase protein exhibiting an open reading frame encoding a 714 amino acid polypeptide, as in SEQ ID NO. 333 with a calculated molecular mass of about 80 kD. Bioinformatic analysis of SEQ ID NO. 332 reveals that this sequence produces α-arabinofuranosidase protein that catalyzes the hydrolysis of terminal non-reducing α-L-arabinofuranoside residues in α-L-arabinosides.

In another embodiment, the 2994 bp long polynucleotide illustrated in SEQ ID NO. 335 is the full length cDNA clone encoding β-galactosidase protein exhibiting an open reading frame encoding 997 amino acid polypeptide, as in SEQ ID NO. 336 with a calculated molecular mass of about 108 kD. Bioinformatic analysis of SEQ ID NO. 335 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 1932 bp long polynucleotide illustrated in SEQ ID NO. 338 is the full length cDNA clone encoding β-galactosidase protein exhibiting an open reading frame encoding 643 amino acid polypeptide, as in SEQ ID NO. 339 with a calculated molecular mass of about 71 kD. Bioinformatic analysis of SEQ ID NO. 338 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 3135 bp long polynucleotide illustrated in SEQ ID NO. 341 is the full length cDNA clone encoding β-galactosidase protein exhibiting an open reading frame encoding 1044 amino acid polypeptide, as in SEQ ID NO. 342 with a calculated molecular mass of about 118 kD. Bioinformatic analysis of SEQ ID NO. 341 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 2070 bp long polynucleotide illustrated in SEQ ID NO. 344 is the full length cDNA clone encoding β-galactosidase protein exhibiting an open reading frame encoding 689 amino acid polypeptide, as in SEQ ID NO. 345 with a calculated molecular mass of about 78 kD. Bioinformatic analysis of SEQ ID NO. 344 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 2994 bp long polynucleotide illustrated in SEQ ID NO. 347 is the full length cDNA clone encoding β-galactosidase protein exhibiting an open reading frame encoding 997 amino acid polypeptide, as in SEQ ID NO. 348 with a calculated molecular mass of about 108 kD. Bioinformatic analysis of SEQ ID NO. 347 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 2985 bp long polynucleotide illustrated in SEQ ID NO. 350 is the full length cDNA clone encoding β-galactosidase protein exhibiting an open reading frame encoding 994 amino acid polypeptide, as in SEQ ID NO. 351 with a calculated molecular mass of about 109 kD. Bioinformatic analysis of SEQ ID NO. 350 reveals that this sequence produces β-galactosidase protein that catalyzes the hydrolysis of β-D-galactosides and α-L-arabinosides. β-galactosidase has catalytic property to hydrolyze lactose into glucose and galactose. So this enzyme has been used for making milk and fermented milk products. It has been used to prevent crystallization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries.

In another embodiment, the 1068 bp long polynucleotide illustrated in SEQ ID NO. 353 is the full length cDNA clone encoding endo-1,4-β-galactanase protein exhibiting an open reading frame encoding 355 amino acid polypeptide, as in SEQ ID NO. 354 with a calculated molecular mass of about 38 kD. Bioinformatic analysis of SEQ ID NO. 353 reveals that this sequence produces endo-1,4-β-galactanase protein that carries out or cause endohydrolysis of (1→4)-β-D-galactosidic linkages present in arabinogalactans.

In another embodiment, the 1065 bp long polynucleotide illustrated in SEQ ID NO. 356 is the full length cDNA clone encoding endo-1,4-β-galactanase protein exhibiting an open reading frame encoding 354 amino acid polypeptide, as in SEQ ID NO. 357 with a calculated molecular mass of about 38 kD. Bioinformatic analysis of SEQ ID NO. 356 reveals that this sequence produces endo-1,4-β-galactanase protein that carries out or cause endohydrolysis of (1→4)-β-D-galactosidic linkages present in arabinogalactans In another embodiment, the 1146 bp long polynucleotide illustrated in SEQ ID NO. 359 is the full length cDNA clone encoding endo-1,4-β-galactanase protein exhibiting an open reading frame encoding 381 amino acid polypeptide, as in SEQ ID NO. 360 with a calculated molecular mass of about 42 kD. Bioinformatic analysis of SEQ ID NO. 359 reveals that this sequence produces endo-1,4-β-galactanase protein that carries out or cause endohydrolysis of (1→4)-β-D-galactosidic linkages present in arabinogalactans.

In another embodiment, the 1281 bp long polynucleotide illustrated in SEQ ID NO. 362 is the full length cDNA done encoding endo-1,6-β-galactanase protein exhibiting an open reading frame encoding 426 amino acid polypeptide, as in SEQ ID NO. 363 with a calculated molecular mass of about 48 kD. Bioinformatic analysis of SEQ ID NO. 362 reveals that this sequence produces endo-1,6-β-galactanase protein that catalyzes of the random hydrolysis of (1→6) linkages in (1→6)-β-D-glucans.

In another embodiment, the 1110 bp long polynucleotide illustrated in SEQ ID NO. 365 is the full length cDNA clone encoding endo-1,4-β-mannanase protein exhibiting an open reading frame encoding 369 amino acid polypeptide, as in SEQ ID NO. 366 with a calculated molecular mass of about 40 kD. Bioinformatic analysis of SEQ ID NO. 365 reveals that this sequence produces endo-1,4-β-mannanase protein that catalyzes the random hydrolysis of (1→4)-β-D-mannosidic linkages in mannans, galactomannans and glucomannans.

The sequences provided by the present invention can also be used as preparatory materials for the rational modification or design novel enzymes with characteristics that enable the enzymes to perform better in demanding processes.

Summarized of the invention are given in Table 1.

TABLE 1

| Invention at a glance. | | |
| --- | --- | --- |
| Enzyme | SEQ ID | Function |
| β-1,4-endoglucanase | SEQ ID NOs. 3, 6, 9, 12, 15, 18, 21, 24, 27, 30, 33, 36, 39, 42, 45 and 48. | Cleaves the internal bonds of the cellulose chain. |
| Cellobiohyrolase | SEQ ID NOs. 51, 54 and 57. | Cleaves cellulose polymer and produces a glucose dimer, cellobiose. |
| β-glucosidase | SEQ ID NOs. 60, 63, 66, 69, 72, 75, 78, 81, 84, 87, 90, 93, 96, 99, 102, 105, 108, 111, 114 and 117. | Hydrolysis the cellobiose and in some cases the cellooligosaccharides to glucose. |
| α-glucosidase | SEQ ID NOs. 120, 123, 126, 129, 132, 135 and 138. | Hydrolysis of terminal, non-reducing (1->4)-linked α-D-glucose residues with release of α-D-glucose. |
| Exo-1,3-β-glucanase | SEQ IQ ID NOs. 141, 144, 147, 150, 153, 156, 159, 162 and 165. | Successive hydrolysis of β-D-glucose units from the non-reducing ends of (1->3)-β-D-glucans, releasing α-glucose. |
| α-1,4-glucan lyase | SEQ ID NOs. 168 and 171. | Sequential degradation of (1->4)-α-D-glucans from the non-reducing end with the release of 1,5-anhydro-D-fructose and D-glucose. |

TABLE 1-continued

Invention at a glance.

| Enzyme | SEQ ID | Function |
| --- | --- | --- |
| α-xylosidase | SEQ ID NOs. 174 and 177. | Hydrolysis of xyloglucan side chains and remove unsubstituted D-xylose residues attached to the glucose located at the non-reducing terminus. |
| d-4,5-unsaturated β-glucuronyl hydrolase | SEQ ID NOs. 180, 183, 186, 189 and 192 | Hydrolytic release of unsaturated glucuronic acids from oligosaccharides produced by the reactions of polysaccharide lyases. |
| Glucan 1,4-α-glucosidase | SEQ ID NOs. 195 and 198. | Hydrolyse of terminal (1->4)-linked α-D glucose residues successively from non-reducing ends of the chains with release of β-D-glucose |
| α-1,2-mannosidase | SEQ ID NOs. 201, 204, 207, 210, 213 and 216. | Remove α-1,2-linked mannose residues from Man (9) (GlcNAc) (2) by hydrolysis. |
| α-1,3-glucanase | SEQ ID NOs. 219, 222, 225, 228, 231, 234, 237, 240, 243, 246, 249 and 252 | Degrade α-1,3-glucans and also ability to remove dental plaques. This enzyme could be applied as active ingredients in mouthwash, toothpaste, dental gel or chewing gum to prevent the accumulation of glucose biopolymers and might also be useful in all other forms of preventive oral hygiene. |
| α-L-fucosidase | SEQ ID NOs. 255 and 258. | Hydrolysing the α-1,6-linked fucose joined to the reducing-end N-acetylglucosamine of the carbohydrate moieties of glycoproteins. |
| Xylan β-1,4-xylosidase | SEQ ID NOs. 261, 264, 267, 270, 273, 276, 279, 282, 285, 288 and 291. | Hydrolysis of (1->4)-β-D-xylans, to remove successive D-xylose residues from the non-reducing termini. |
| Endo-1,5-α-L-arabinosidase | SEQ ID NOs. 294, 297, 300 and 303. | Hydrolysis of the α-1,5-linked L-arabinofuranoside backbone in (1->5)-arabinans. |
| Endo-1,4-β-xylanase | SEQ ID NOs. 306, 309, 312 and 315. | Endohydrolysis of (1->4)-β-D-xylosidic linkages in xylans and produce xylose. This enzyme is crucial for depolymerization of hemicelluloses and it has a potential industrial application, such as in bio bleaching, paper making and in the food and animal feed industries. Other potential applications include the conversion of xylan in wastes from agriculture and food industries into xylose, and the production of fuel and chemical feedstocks. |
| α-arabinofuranosidase | SEQ ID NOs. 318, 321, 324, 327, 330 and 333. | Hydrolysis of terminal non-reducing α-L-arabinofuranoside residues in α-L-arabinosides. |
| β-galactosidase | SEQ ID NOs. 336, 339, 342, 345, 348 and 351. | β-galactosidase has catalytic property to hydrolyze lactose into glucose and galactose. So this enzyme has been used for making milk and fermented milk products. It has been used to prevent crystalization of lactose, to improve sweetness, to increase the solubility of the milk product in dairy industries. Moreover, it has been used to produce low lactose containing food products for low lactose tolerance people. Therefore, the use of β-galactosidase is one of the most promising applications of enzymes to food industries. |
| Endo-1,4-β-galactanase | SEQ NOs. 354, 357 and 360. | Endohydrolysis of (1->4)-β-D-galactosidic linkages in arabinogalactans. |
| Endo-1,6-β-galactanase | SEQ ID NO. 363. | Hydrolysis of (1->6) linkages in (1->6)-β-D-glucans. |
| Endo-1,4-β-mannanase | SEQ ID NO. 366. | Hydrolysis of (1->4)-β-D-mannosidic linkages in mannans, galactomannans and glucomannans. |

The present invention also relates to (a) nucleic acid vectors that comprise a nucleotide sequence comprising any of the foregoing sequences of the genes and/or their complements; (b) expression constructs that comprise a nucleotide sequence comprising any of the foregoing coding sequences of the genes operably linked with a regulatory element that directs the expression of the coding sequences; and (c) recombinant host cells that comprise any of the foregoing sequences of the gene, including coding regions operably linked with a regulatory element that directs the expression of the coding sequences in the host cells.

The techniques for modifying polynucleotide sequences utilizing recombinant DNA methods are well known in the art. The various sequences may be joined in accordance with known techniques, such as restriction, joining complementary restriction sites and ligating, blunt ending by filling in overhangs and blunt ligation or the like. Poly linkers and adapters may be employed, when appropriate, and introduced or removed by known techniques to allow for ease of assembly of the DNA vectors and expression constructs. A large number of vectors are available for cloning and genetic manipulation. Normally, cloning can be performed in *E. coli*.

In another embodiment of the invention, vectors that comprise an enzyme gene sequence of the invention may further comprise replication functions that enable the transfer, maintenance and propagation of the vectors in one or more species of host cells, including but not limited to *E. coli* cells, filamentous fungal cells, yeast cells, and *Bacillus* cells. The vector may contain any means for assuring self-replication. Alternatively, the vector may be one which, when introduced into the host cell, is integrated into the genome and replicated together with the chromosome(s) into which it has been integrated. The choice of the vector will typically depend on the compatibility of the vector with the host cell into which the vector is to be introduced.

Expression construct of the invention comprises a promoter, a nucleotide sequence encoding for a gene sequence of the invention, a transcription termination sequence and selectable marker (optional). Any method known in the art for introducing this expression construct into a host cell can be used. Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238 023 and Yelton M M, Hames J E, Timberlake W E. Transformation of *Aspergillus nidulans* by using a trpC plasmid. PNAS, 1984; 81(5):1470-1474. Suitable methods for transforming *Fusarium* species are described by Malardier L, Daboussi M J, Julien J, Roussel F, Scazzocchio C, Brygoo Y. Cloning of the nitrate reductase gene (niaD) of *Aspergillus nidulans* and its use for transformation of *Fusarium oxysporum*. Gene 1989; 78:147-156, and WO 96/00787. Yeast may be transformed using the procedures described by Becker D M, Guarente L. High-efficiency transformation of yeast by electroporation. In: Abelson J N and Simon M I (eds), Guide to Yeast Genetics and Molecular Biology, Methods in Enzymology, 1991; 194:182-187, Academic Press, Inc., New York; Ito H, Fukuda Y, Murata K, Kimura A. Transformation of intact yeast cells treated with alkali cations. Journal of Bacteriology, 1983; 153: 163-168 and Hinnen A, Hicks J B, Fink G R. Transformation of yeast. PNAS, 1978; 75 (4): 1929-1933.

For industrial applications, the enzymes of the present invention are produced by a fungal cell. Preferably, the expression host cell is a filamentous fungal cell which has been used in large scale industrial fermentation. Appropriate cell lines or host systems can be chosen to ensure the correct modification and processing of the foreign protein expressed. Preferably, an expression host is selected which is capable of the efficient secretion of their endogenous proteins. A host cell may also be chosen for deficiencies in extracellular protease activities since the secreted enzyme may be degraded in the culture medium.

The present invention also relates to methods for producing a polypeptide of the present invention, comprising and/or consisting of: (i) cultivation of a cell, which in its wild-type form is capable of producing the polypeptide, under conditions conducive for production of the polypeptide; and (ii) recovery of the polypeptide. In a preferred aspect, the cell is *M. phaseolina*.

In another embodiment of the invention also relates to methods for producing a polypeptide of the present invention, comprising and/or consisting of: (i) cultivation of a host cell under conditions conducive for production of the polypeptide, wherein the host cell comprises a nucleotide sequence or the complement of such sequences of any or any combination of SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362, 365, 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 or 364, wherein the nucleotide sequence encodes a polypeptide which comprises and/or consists of any of the mature polypeptide of SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 or 366, and (ii) recovery of the polypeptide.

In another embodiment of the present invention, the expression host cells or transformants are cultivated in a suitable nutrient medium for growth and expression of proteins using methods well known in the art. For example, the cell may be cultivated by shake flask cultivation, and small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art (see In: More Gene Manipulations in Fungi. Bennett J W, Lasure L., (eds). 1991; Academic Press, San Diego, Calif.).

If the polypeptide is secreted into the nutrient medium, the polypeptide can be recovered directly from the medium. If the polypeptide is not secreted into the medium, it can be recovered from cell lysates.

The polypeptides may be detected using methods known in the art that are specific for the polypeptides. These detection methods may include use of specific antibodies, formation of an enzyme product, or disappearance of an enzyme substrate. An enzyme assay may be used to determine the activity of the polypeptide.

The produced polypeptide may be recovered using methods known in the art. The polypeptide may be recovered in various methods from the nutrient medium by conventional procedures including, but not limited to, filtration, centrifugation, extraction, spray-drying, evaporation and precipitation or combination thereof.

The polypeptides of the present invention may be purified by a variety of procedures which are well known in the art including, but not limited to, chromatography method (such as ion exchange, affinity, hydrophobic, chromatofocusing, and size exclusion), electrophoretic procedures (such as isoelectric focusing), differential solubility (such as ammonium sulfate precipitation), SDS-PAGE, or extraction to obtain substantially pure polypeptides (see details in Protein Purification, Principles, High Resolution Methods and Applications. Janson J C, Rydén L. (eds( ). 1989; VCH Publishers Inc., New York).

The present invention also relates those gene products (e.g., RNA or proteins) that are encoded by the gene sequences set forth in SEQ ID Nos. 2, 5, 8, 11, 14, 17, 20, 23, 26, 29, 32, 35, 38, 41, 44, 47, 50, 53, 56, 59, 62, 65, 68, 71, 74, 77, 80, 83, 86, 89, 92, 95, 98, 101, 104, 107, 110, 113, 116, 119, 122, 125, 128, 131, 134, 137, 140, 143, 146, 149, 152, 155, 158, 161, 164, 167, 170, 173, 176, 179, 182, 185, 188, 191, 194, 197, 200, 203, 206, 209, 212, 215, 218, 221, 224, 227, 230, 233, 236, 239, 242, 245, 248, 251, 254, 257, 260, 263, 266, 269, 272, 275, 278, 281, 284, 287, 290, 293, 296, 299, 302, 305, 308, 311, 314, 317, 320, 323, 326, 329, 332, 335, 338, 341, 344, 347, 350, 353, 356, 359, 362 and 365. The enzyme gene products of the invention also includes those RNA or proteins that are encoded by the genomic sequences of the genes as set forth in SEQ ID Nos. 1, 4, 7, 10, 13, 16, 19, 22, 25, 28, 31, 34, 37, 40, 43, 46, 49, 52, 55, 58, 61, 64, 67, 70, 73, 76, 79, 82, 85, 88, 91, 94, 97, 100, 103, 106, 109, 112, 115, 118, 121, 124, 127, 130, 133, 136, 139, 142, 145, 148, 151, 154, 157, 160, 163, 166, 169, 172, 175, 178, 181, 184, 187, 190, 193, 196, 199, 202, 205, 208, 211, 214, 217, 220, 223, 226, 229, 232, 235, 238, 241, 244, 247, 250, 253, 256, 259, 262, 265, 268, 271, 274, 277, 280, 283, 286, 289, 292, 295, 298, 301, 304, 307, 310, 313, 316, 319, 322, 325, 328, 331, 334, 337, 340, 343, 346, 349, 352, 355, 358, 361 and 364. The enzymes of the invention comprises an amino acid sequence selected from the group comprising and/or consisting of SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366.

The enzymes of the present invention display at least one of the activities of an enzyme selected from the group comprising and/or consisting of β-1,4-endoglucanase, cellobiohydrolase, β-glucosidase, α-glucosidase, Exo-1,3-β-glucanase, α-glucan lyase, α-xylosidase, d-4,5-unsaturated b-glucuronyl hydrolase, amyloglucosidase, α-1,2-mannosidase, α-1,3-glucanase, α-fucosidase, xylan 1,4-β-Xylosidase, endo-1,5-α-arabinosidase, Endo-1,4-β-xylanase, α-arabinofuranosidase, β-galactosidase, Endo-1,4-β-galactanase, Endo-1,6-β-glucanase and endo-β-1,4-mannanase. The enzyme gene products of the invention can be readily produced, e.g., by synthetic techniques or by methods of recombinant DNA technology using techniques that are well known in the art (See, Creighton T E. Proteins: Structures and Molecular Principles, 1983; W. H. Freeman and Co., N.Y.)

In another embodiment, the methods and compositions of the invention also include proteins and polypeptides that represent functionally equivalent gene products. Such functionally equivalent gene products include, but are not limited to, natural variants of the polypeptides having an amino acid sequence set forth in SEQ ID Nos. 3, 6, 9, 12, 15, 18, 21, 24, 27, 30, 33, 36, 39, 42, 45, 48, 51, 54, 57, 60, 63, 66, 69, 72, 75, 78, 81, 84, 87, 90, 93, 96, 99, 102, 105, 108, 111, 114, 117, 120, 123, 126, 129, 132, 135, 138, 141, 144, 147, 150, 153, 156, 159, 162, 165, 168, 171, 174, 177, 180, 183, 186, 189, 192, 195, 198, 201, 204, 207, 210, 213, 216, 219, 222, 225, 228, 231, 234, 237, 240, 243, 246, 249, 252, 255, 258, 261, 264, 267, 270, 273, 276, 279, 282, 285, 288, 291, 294, 297, 300, 303, 306, 309, 312, 315, 318, 321, 324, 327, 330, 333, 336, 339, 342, 345, 348, 351, 354, 357, 360, 363 and 366.

Such equivalent gene products can contain, e.g. deletions, additions or substitutions of amino acid residues within the amino acid sequences encoded by the enzyme gene sequences described above, but which result in a silent change, thus producing a functionally equivalent product. Amino acid substitutions can be made on the basis of similarity in polarity, charge, solubility, hydrophobicity, hydrophilicity and/or the amphipathic nature of the residues involved.

Other modifications of the gene product coding sequences described above can be made to generate polypeptides that are better suited, e.g., for expression, for scale up, etc. in a chosen host cell. For example, cysteine residues can be deleted or substituted with another amino acid in order to eliminate disulfide bridges.

Another embodiment of the present invention further includes enzymes of the present invention in solid form. Enzymes in solid form or enzyme granulate can be used, for example, in solid detergent and in animal feed. Methods of making solid forms of enzymes are well known in the art, such as but not limited to prilling (spray-cooling in a waxy material), extrusion, agglomeration, or granulation (dilution with an inert material and binders). Solid enzymatic compositions comprising a solid form of an enzyme of the invention, in the form of mixed powder, tablets, and the like, is contemplated.

The present disclosure includes as contained in the appended claims, as well as that of the foregoing description. Although this invention has been described in its preferred form with a degree of particularity, it is understood that the present disclosure of the preferred form has been made only by way of example and that numerous changes in the details of construction and the combination and arrangements of parts may be resorted to without departing from the scope and spirit of the invention and claims.

Various references are cited herein, the disclosures of which are incorporated by reference in their entireties.

EXAMPLE

The following example is intended to further illustrate the invention, without any intent for the invention to be limited to the specific embodiments described therein.

Example 1 Isolation of Genomic DNA from *M. phaseolina*

Genomic DNA was isolated from *M. phaseolina* strain ms6 using the procedures described by Kieser T, Bibb M J, Buttner M J, Chater K F, Hopwood D A. Practical *Streptomyces* Genetics, 2000; John Innes Foundation, Norwich, UK, pp. 162-208. Briefly, mycelia were scraped from a stock Petri plate using inoculating loop and inoculated into a liquid potato-dextrose media in a conical flask. The conical flask was incubated without shaking for about 72 hours at 30° C. The mycelia grow on the surface at the air-medium interface. The mycelia were harvested using a sterile toothpick and placed between sterile paper towels and several washed with physiological solution (Sodium phosphate buffer pH 7.0). The mycelia were squeezed to remove excess liquid and the harvested mycelia were allowed to air dry for 30 minutes. The semi-dry mycelia were placed in liquid nitrogen and grinding to generate fine powder and finally isolate the DNA following the protocol describe in Kieser T, Bibb M J, Buttner M J, Chater K F, Hopwood D A. Practical *Streptomyces* Genetics, 2000; John Innes Foundation, Norwich, UK, pp. 162-208.

Example 2 Designing and Synthesis of Primers

The primers used in the study were either designed from the manually curated transcriptome and the "gene models" predicted from the genomic sequences of *M. phaseolina* ms6 strain, by choosing the sequences manually with complete ORFs or using databases where similar genes have been successfully isolated from other plants. Comparative bioinformatic analysis of the nucleotide sequences obtained from transcriptome were carried out using NCBI BLAST, BLASTP, RPS-BLAST, BLASTX and PSI-BLAST to identify homologues of the related genes and for the proper identification of gene. Nucleotide sequence alignments were performed using clustalW version 1.82 whenever multiple sequences were found from the "gene pool". The alignment was then edited. Gene specific primers (both forward and reverse) were selected manually or through Primer 3 plus tool and the primers were custom synthesized.

All oligonucleotides used in this study were synthesized and HPLC purified by the supplier and procured from Integrated DNA Technologies (IDT). Stock solution of 100 pmol were prepared in autoclaved $ddH_2O$ and stored at about −20° C., in aliquots for use.

Oligonucleotides Sequences Used as Primers for PCR

| Gene name | SEQ ID NO. | Primer Sequence | Amplified product (bp) |
|---|---|---|---|
| β-1,4-endoglucanase | 1 | forward CTGCCCATCAGTCGCTGTGCC<br>Reverse TCGCTGCATTTCCTTCGCGT | 701 |
| β-1,4-endoglucanase | 4 | Forward TAGACACCTTCCCCGCCTTGGT<br>Reverse CCGCTCCCTTATGGCCCTGCT | 748 |
| β-1,4-endoglucanase | 7 | Forward CGCTAGCCGCTCAGTCACCA<br>Reverse GCGATCCGCTTAGAAGAGGCGG | 857 |
| β-1,4-endoglucanase | 10 | Forward TTGCGGCTAGCCCGTAGCCTT<br>Reverse GGGCACTGGAAGCACGGTGT | 1084 |
| β-1,4-endoglucanase | 13 | Forward ATACGCGATCCGCCGTGTTGT<br>Reverse GCGCAGCAGGCTCTCTAGCAC | 1491 |
| β-1,4-endoglucanase | 16 | Forward ACGGCCCGGTGCCTTTTTGA<br>Reverse CTGGACCGCCCACGCTCAGA | 1084 |
| β-1,4-endoglucanase | 19 | Forward GCCCGCTGATCGAGCATTGA<br>Reverse GCAGGTGGGCAGTGAAACCC | 1661 |
| β-1,4-endoglucanase | 22 | Forward ATGCGGTCGGGGAACATTGCG<br>Reverse CTCCGCTCAGCTGGGGCACT | 864 |
| β-1,4-endoglucanase | 25 | Forward CCCTCCCCTACCCCTTGCCAT<br>Reverse CATGCTCTCCGCTCGCGCTTA | 1150 |
| β-1,4-endoglucanase | 28 | Forward AGCGGTCTGAACTTCCGGGACA<br>Reverse TCGCCAGCCGGAAGGCAGTT | 677 |
| β-1,4-endoglucanase | 31 | Forward TCTGACTGCTCGACAGACGTGCT<br>Reverse GCGAACTGGTGGATGCTCAGGC | 916 |
| β-1,4-endoglucanase | 34 | Forward GCTCCCGCCTTGCCATTCCTTT<br>Reverse CAAGAACCCGCCTCGCAAACG | 1224 |
| β-1,4-endoglucanase | 37 | Forward TCCGGGGGAATGCTGCGATCA<br>Reverse CACCCGCCGTCCAATGTTAGCC | 1891 |
| β-1,4-endoglucanase | 40 | Forward CGGCGATTTTGCTCCCACCG<br>Reverse CCATTCCACAGGGCGGGTTT | 1964 |

-continued

| Gene name | SEQ ID NO. | Primer Sequence | Amplified product (bp) |
|---|---|---|---|
| β-1,4-endoglucanase | 43 | Forward AAGAGGGACGCTCAGGGGAGT<br>Reverse GGCCCTCAAGCATTCGCCCAA | 1300 |
| β-1,4-endoglucanase | 46 | Forward ACCCGCCGAACACAGCAAACA<br>Reverse GTCCCCGTCAAGGCCCAACC | 1580 |
| Cellobiohydrolyase | 49 | Forward ATCACCAACGGCGCGCAGAA<br>Reverse GCCGCGTACCTCCTCGCATC | 1165 |
| Cellobiohydrolyase | 52 | Forward GAGCCCAGTGAGACCCTGCT<br>Reverse GGGGCGTTGCCCTGATGTGA | 839 |
| Cellobiohydrolyase | 55 | Forward CGCTACGGCGGCATCTGTGA<br>Reverse TGAGTTACCCGGCGGTTGTCC | 693 |
| β-glucosidase | 58 | Forward CAAGCCTGGACGATACTCCCGA<br>Reverse CTTCCCACCTCCACTCAACCCA | 2603 |
| β-glucosidase | 61 | Forward CACCTGAACTCTTGCCCGCT<br>Reverse CACAACGCTCAAGGCGCAAA | 2897 |
| β-glucosidase | 64 | Forward GTGCCGGTCGTTACGGTTCA<br>Reverse CGTGTACGCTGGTGGTCATCG | 2050 |
| β-glucosidase | 67 | Forward ACTTGCCTAATGACCCCCGC<br>Reverse TCACGCAACCGGACTCTCCA | 2843 |
| β-glucosidase | 70 | Forward CTTGCGCTTCGCTGACCACG<br>Reverse GCACCACCTCTCTCGATGCC | 2652 |
| β-glucosidase | 73 | Forward CCGCTTCTCTCGTCGTTGCC<br>Reverse TGCAGGGAGAACAGTGTAGCG | 3245 |
| β-glucosidase | 76 | Forward TCAGCATGGACAACGCCCTGG<br>Reverse GATTGTGACGGTGGCCTCGCC | 2165 |
| β-glucosidase | 79 | Forward GCCCACGCCTGCTCGTTCAAT<br>Reverse ACCCACCACTCCCACCGATCC | 2126 |
| β-glucosidase | 82 | Forward TGGCCCGACCACCAACATGC<br>Reverse CGCCCCGGAACGTGGAAAGG | 2435 |
| β-glucosidase | 85 | Forward TGACGAGCCATGAGGTCCGC<br>Reverse CGCTTGGACGTCGATGCAGT | 2630 |
| β-glucosidase | 88 | Forward TGCAGGCCCCTTTCATCTGCC<br>Reverse ACCGCTATTCCGGCGCTCTC | 2183 |
| β-glucosidase | 91 | Forward ACCGCTGCCAGTCACTGCTC<br>Reverse GGCATTTCGAGCCCCCAATCG | 2024 |
| β-glucosidase | 94 | Forward CCACGGACTCCGCTCACCAG<br>Reverse GACGGCTCGTCCAGATCCTCA | 2104 |
| β-glucosidase | 97 | Forward ACAACCGAGATGGCAGAGGCA<br>Reverse CGCCGAAAACCTGCTCGCAA | 2057 |
| β-glucosidase | 100 | Forward ACGACGCATACGCGGCGAAG<br>Reverse GCCTGGTAGGCCCCCAGAAAC | 684 |
| β-glucosidase | 103 | Forward CGCCTTCGGTAGTCTCCGCTT<br>Reverse CGGTTTGGCAAGATGGCGGC | 2096 |
| β-glucosidase | 106 | Forward TTGCGACGGAGATGCGTGGG<br>Reverse CTGCATCCCCCTGCCATTAGC | 2080 |
| β-glucosidase | 109 | Forward ATATCGACCGTCTCGCGGCCA<br>Reverse GATCAGGGACGGCGGGGAAGA | 753 |
| β-glucosidase | 112 | Forward ATCACCGCCAAAACACCACGC<br>Reverse TTACGCCAACGTCGCACTCAG | 2246 |
| β-glucosidase | 115 | Forward CGGGTTGGAGCCGCAGTGATT<br>Reverse AAACCGTCAGCGTCCCCTCCA | 2794 |

-continued

| Gene name | SEQ ID NO. | Primer Sequence | Amplified product (bp) |
|---|---|---|---|
| α-glucosidase | 118 | Forward TCCCTTGGCCCTCCTCCGAAC<br>Reverse CCCTGCTTTCGGCTACCGCTC | 3145 |
| α-glucosidase | 121 | Forward GTGCGCCGGACCTACCGAGA<br>Reverse CAGGAGTGCGCTCTGGACGGA | 2380 |
| α-glucosidase | 124 | Forward TCGCGGGATGCTCACCGTACT<br>Reverse CGCATTCACTCACTGCCACCCT | 2430 |
| α-glucosidase | 127 | Forward CCATCATGCCGTCCGCAGCA<br>Reverse CGAAACACGGAAACACCCGCAG | 3227 |
| α-glucosidase | 130 | Forward TTCCAATGGCACCTTCGCCG<br>Reverse ACACCTGGCCTACCCGTCTC | 3138 |
| α-glucosidase | 133 | Forward CATCCCCTGCTCCGGCTTCC<br>Reverse CGTCGAGAATTGGTCCGTATGTCC | 1747 |
| α-glucosidase | 136 | Forward GGTGGAGCGCATCGTCAGGG<br>Reverse CCACGCGCTCAGTCCGCTTT | 1490 |
| Exo-1,3-β-glucanase | 139 | Forward GTCTCCACGCCTCTTCCGTCCT<br>Reverse TTGGTTGGGATTGCGGGCGTT | 1977 |
| Exo-1,3-β-glucanase | 142 | Forward CGGCTCCACATTCCAGCCCC<br>Reverse GGAACGGAGAGCCTCCAGTTATGC | 1504 |
| Exo-1,3-β-glucanase | 145 | Forward ACTGCAGACACCACGGACGA<br>Reverse TGCTGACGCGGCTGTTACGA | 1401 |
| Exo-1,3-β-glucanase | 148 | Forward CCCCATCCTCCAACGGTCCTCA<br>Reverse CCGCCTTCCCGAAACAGCTCG | 1013 |
| Exo-1,3-β-glucanase | 151 | Forward ATTAGCTGCACCGTCCCCGC<br>Reverse ACCTCGCAGCCCAATGCAAGAC | 1232 |
| Exo-1,3-β-glucanase | 154 | Forward CCCCCAGCGCATTCTGAGGC<br>Reverse ACCAGCCCAGACAGAACCCCT | 1569 |
| Exo-1,3-β-glucanase | 157 | Forward CGCTGGCGCAGTTGGATGTA<br>Reverse CGCTCATGCGCTTTGATGCC | 2377 |
| Exo-1,3-β-glucanase | 160 | Forward TCCCGCCCAGCAGCTACGAT<br>Reverse TGCGGTAGAAGGGCTGCGATG | 2771 |
| Exo-1,3-β-glucanase | 163 | Forward GCGGGAGCAACCGTCTTTCT<br>Reverse ATTCCGTCCCGGCACCTCAG | 3194 |
| α-glucan lyase | 166 | Forward ATCCTCAGCCTCGCATTGGGT<br>Reverse CGAAAGGTTCGTGCCTCCCAC | 2406 |
| α-glucan lyase | 169 | Forward CAGCTGTACTTCAGCGCACG<br>Reverse TTAATGAGAATGGCTGCCTGCCG | 4195 |
| α-xylosidase | 172 | Forward ACCAGCCCGCCACCATGTTC<br>Reverse CGCGGTTGCTCTCAGGCTGT | 2137 |
| α-xylosidase | 175 | Forward CGGGTCGAAGGAGCTCACGC<br>Reverse GGGCGAAGGATCAGACGCGG | 1155 |
| d-4,5-unsaturated β-glucuronyl hydrolase | 178 | Forward TTGGATGGCCGCCAGCATCAT<br>Reverse CAGACCCCTTCGGACCCCGTA | 1358 |
| d-4,5-unsaturated β-glucuronyl hydrolase | 181 | Forward CCAGTAGCCCGCCGTCTGGT<br>Reverse CCGATTCGGGCTGATCCGCAA | 1331 |
| d-4,5-unsaturated β-glucuronyl hydrolase | 184 | Forward CGTGTGCTGCGCAAAGAATGGC<br>Reverse CGAAATATCGCCGCAAGCCCAC | 1450 |
| d-4,5-unsaturated β-glucuronyl hydrolase | 187 | Forward ACGCTTGCTCCGATTCCGCC<br>Reverse TCTACGCCGTGAAGGCGTCGT | 1258 |
| d-4,5-unsaturated β-glucuronyl hydrolase | 190 | Forward AACCGCAACCATGACCTCGGC<br>Reverse AGCGAGTGCCATCCGAGCTTC | 1284 |

-continued

| Gene name | SEQ ID NO. | Primer Sequence | Amplified product (bp) |
|---|---|---|---|
| Glucan 1,4-α-glucosidase | 193 | Forward GCGCCTTCTTCGCACCGTCAT<br>Reverse ATCCTGCCGCGACGCTCAAAG | 1851 |
| Glucan 1,4-α-glucosidase | 196 | Forward TTGCAGCCAGCCTCCTTCTCT<br>Reverse AGCGAACCCCTCATCGTCTCG | 2502 |
| α-1,2-mannosidase | 199 | Forward CCCGCTGACCGTCCAAAGCC<br>Reverse ACGCGTTCCAAAGCGGGTCA | 3109 |
| α-1,2-mannosidase | 202 | Forward TGCCACGACGCGAATTGATCG<br>Reverse AGCCGCCACGCCTCAAACTC | 3175 |
| α-1,2-mannosidase | 205 | Forward ACTGGTCCCCATGGTCCTGCT<br>Reverse TTGTCAGGCTGTTTGCGCAGC | 2021 |
| α-1,2-mannosidase | 208 | Forward CATGTCCCGCTTCGCGTACT<br>Reverse CTTGGCCTTTGCGTCCCGAAT | 3016 |
| α-1,2-mannosidase | 211 | Forward GGCGGTACGAGGGTCACGGG<br>Reverse TGTACCGCACCCCGCTGTTT | 2009 |
| α-1,2-mannosidase | 214 | Forward GCTGTAGGTTCGTCGCCCTC<br>Reverse CAGTCGGCAGCCCGTCATAA | 2741 |
| α-1,3-glucanase | 217 | Forward CCCGCCGCTCTGGATAGTCG<br>Reverse CCTCCCACCAAGCCCCAAGC | 1854 |
| α-1,3-glucanase | 220 | Forward CGGGTGTTGCTGTTTGTCTTCGT<br>Reverse CCGCCGTTCCAAGCAGAGGG | 1786 |
| α-1,3-glucanase | 223 | Forward TCCCCCTCAAGAAGCTGCCAGT<br>Reverse TGGCCATCCTCTTGCCCTCGTT | 1464 |
| α-1,3-glucanase | 226 | Forward TCCTTCGAGGGCTGTCCGATCC<br>Reverse TCCGCCTGTTCCTTACGCCAC | 1531 |
| α-1,3-glucanase | 229 | Forward GCCATGGAGGTCTGTGGGAGC<br>Reverse CCACGTGGTCAGCGCTTGAGGC | 853 |
| α-1,3-glucanase | 232 | Forward GGCCGCCGACTTCAAGCTCT<br>Reverse TGATGCGCGCTCCTTAGCCAG | 1226 |
| α-1,3-glucanase | 235 | Forward TTGGTTCGCCTCCAGACCGCT<br>Reverse GCAGCGGGAGGTTCTCTTCGC | 742 |
| α-1,3-glucanase | 238 | Forward ATGGACGACCGGCCCGACT<br>Reverse CATGCCGCGAGAACGAGTCCAC | 908 |
| α-1,3-glucanase | 241 | Forward ACGCTCGCTTTCTTGTCCAAAGCA<br>Reverse ACCTGGTTGAGCGGTAATAGAGCTT | 934 |
| α-1,3-glucanase | 244 | Forward GCAATGGGCCTCGACGGCTT<br>Reverse ATGCACCCACCCCACCCCAT | 1274 |
| α-1,3-glucanase | 247 | Forward ATCATGGCTTCCAGTCGCGG<br>Reverse ATCCCCGGTTGACATCCGCT | 1753 |
| α-1,3-glucanase | 250 | Forward CGCTGCCGAACTCTGCCAGT<br>Reverse GCGTGTCCCACGCTGATGCT | 1693 |
| α-fucosidase | 253 | Forward TGTCACCCTCGTGCTCTGCT<br>Reverse AATGGCTCGCGAAAGCGCAG | 2688 |
| α-fucosidase | 256 | Forward GTGGATTCGGGCTGACCCCC<br>Reverse GCTGCCTTTGCATGGACGCAG | 2392 |
| Xylan β-1,4-xylosidase | 259 | Forward TGGACCTTCATGGACCGCGT<br>Reverse TGCTTCGGCTCTGCATGAACCA | 1518 |
| Xylan β-1,4-xylosidase | 262 | Forward ACACCCGCACCACAATGCCG<br>Reverse CGGCCCGCTGTGTACAAGGT | 1655 |
| Xylan β-1,4-xylosidase | 265 | Forward TCCGTCGATTGTGGCCTTCCA<br>Reverse AGCTCCCACGCACCCTCACA | 1642 |

-continued

| Gene name | SEQ ID NO. | Primer Sequence | Amplified product (bp) |
|---|---|---|---|
| Xylan β-1,4-xylosidase | 268 | Forward ATCCTCCCCTAGCCATGCCG<br>Reverse GGTCACTGCCCACCTCCTCT | 2806 |
| Xylan β-1,4-xylosidase | 271 | Forward CGCAGATGACTGTCGCAGACC<br>Reverse GCCCTACCACCCACTTTCGC | 3489 |
| Xylan β-1,4-xylosidase | 274 | Forward CCGTCGCACGACCGGGAAAC<br>Reverse AGGTCATGCCATCCAGTGCTGA | 960 |
| Xylan β-1,4-xylosidase | 277 | Forward CACAGGCTGTAAGACCTACCTCCG<br>Reverse ACAGCAGAGGTGACTGGATAAGGGT | 1960 |
| Xylan β-1,4-xylosidase | 280 | Forward GCCGGCTTCCTTCCGATCCC<br>Reverse CGACTTCTTCAAGTCTCCCCGCC | 1654 |
| Xylan β-1,4-xylosidase | 283 | Forward CGTTTCCACCCGCAGGAAGCA<br>Reverse ATGAGCGCTCGCGTCGGTAGT | 1896 |
| Xylan β-1,4-xylosidase | 286 | Forward AGCGAAGGCGACCACAGACCA<br>Reverse TTCTGAGCCACCGCCTCCTGG | 2049 |
| Xylan β-1,4-xylosidase | 289 | Forward AAACGCGAAAGTGGGGCAGGA<br>Reverse CGGCCCAGCAGATCCGCATA | 2050 |
| Endo-1,5-α-arabinosidase | 292 | Forward ATGCAGTGCCGAGGCGGTTG<br>Reverse AAGCACGATTGCTTGGGCGGT | 1366 |
| Endo-1,5-α-arabinosidase | 295 | Forward CCACGATGCTGTCCTCCCTGG<br>Reverse AACGGATGATCGCGGGCTTGA | 1384 |
| Endo-1,5-α-arabinosidase | 298 | Forward GCCCCAGCGATGCTGTGCTA<br>Reverse TGCGCGGGAATCAACCCCACAC | 1206 |
| Endo-1,5-α-arabinosidase | 301 | Forward CTGCCCAACAAAGCCTCCCCA<br>Reverse ATTAAGCCGCCTTCGCCGCAA | 1167 |
| Endo-1,4-beta-xylanase | 304 | Forward TGCTGCTCGACTTGCTCGCAT<br>Reverse ACTCCTCATCCTCCCTACAAGGCA | 1222 |
| Endo-1,4-beta-xylanase | 307 | Forward GGCTGGAGCGGTGACAGCAG<br>Reverse CACACACGCCCCGCCTACAG | 1395 |
| Endo-1,4-beta-xylanase | 310 | Forward CCCCCACATTGCGTCCAGGAG<br>Reverse CATCCCAAGGAAGGGCAGCG | 1220 |
| Endo-1,4-beta-xylanase | 313 | Forward TCCAGGTCGTACGGGCAAGC<br>Reverse CGCATGCCAGCGACGCTACG | 1615 |
| α-arabinofuranosidase | 316 | Forward CGTCGAGTTGCAATGCCCGC<br>Reverse GCGGCCCCGTCTCCTAAAGC | 1317 |
| α-arabinofuranosidase | 319 | Forward TTGTACGACCTGCTCCGCCG<br>Reverse AGGTCGGTGCCGCGCTCAAA | 1667 |
| α-arabinofuranosidase | 322 | Forward CGAGCTCCCTGTTCCCTGGC<br>Reverse TCACGCATCCGGCTCCCCAG | 1520 |
| α-arabinofuranosidase | 325 | Forward AGACATGCGCGTCGCTCTTCC<br>Reverse CCAGTCCGCTCCGCCAGAAT | 1206 |
| α-arabinofuranosidase | 328 | Forward GCCTGCATCCATCCACCCGTC<br>Reverse CCATAGCCACACCACACCGTCC | 2324 |
| α-arabinofuranosidase | 331 | Forward CTTCTCACCGCCGCGCTGTT<br>Reverse CACGCCGTCTTGCTATGCATCC | 2406 |
| β-galactosidase | 334 | Forward CCTCCACGATGGCGCGGTTG<br>Reverse AGGGGAACAGACGGCAAGCAC | 3144 |
| β-galactosidase | 337 | Forward CCAGACTCCGTGCTTCGGGA<br>Reverse CATATTGCGGCATCGCCACCC | 2346 |
| β-galactosidase | 340 | Forward GGATTTCCCGGGGCGTGACT<br>Reverse AGGCAGTCGGTGGACAGCTC | 3568 |

| Gene name | SEQ ID NO. | Primer Sequence | Amplified product (bp) |
|---|---|---|---|
| β-galactosidase | 343 | Forward GCCCCACCTTTCCCGCTGAG<br>Reverse ACGTAGCGGCCGACATCTTGA | 2337 |
| β-galactosidase | 346 | Forward TGCTCTCCGCACTGCGTTTT<br>Reverse CCTCATCACTCGGCTCCCGT | 3424 |
| β-galactosidase | 349 | Forward CCTTCACCGGCAGCCATGCG<br>Reverse ACACCGAGGCTGCAAGCCAAA | 2885 |
| Endo-1,4-β-galactanase | 352 | Forward ACAGCCTGGACTAAGCGGCG<br>Reverse GTGGAGATGAGGGCAGTCCGC | 1339 |
| Endo-1,4-β-galactanase | 355 | Forward GCGCCGTTTTGGGAGACACC<br>Reverse CGCCCGGAACGCCTTCTCATT | 1111 |
| Endo-1,4-β-galactanase | 358 | Forward ACACTGCCCCGCTGTCAGGA<br>Reverse GGGCCAATACCCCACCTGCG | 1360 |
| Endo-1,6-β-galactanase | 361 | Forward GGGCCAGGGCGTCAATTCCC<br>Reverse CGCGCCTGCATCAGTGTCCA | 1941 |
| Endo-1,4-β-mannanase | 364 | Forward CAGGCCACACCCACACTCCT<br>Reverse TGGGCACCTCGATCGTGAGA | 1459 |

Example 3 Amplification, Cloning and Sequencing of Cellulases and Hemicellulases from *M. phaseolina* ms6

Total RNA was isolated from three days old mycelium grown on liquid medium as previously described by Chomczynski P and Sacchi N, Single-step method of RNA isolation by acid guanidinium thiocyanate-phenol-chloroform extraction. Anal Biochem 1987, 162: 156-159). The quality or the integrity of the RNA was checked by agarose gel electrophoresis and was quantified using Thermo Scientific Nano Drop 2000 as per standard procedures. cDNA first strand was synthesised using SuperScript III reverse transcriptase (Invitrogen) following the manufacturer's instructions. The gene was amplified from the cDNA by PCR using the gene specific primers. The PCR reaction (50 µL) contained 1 µL of cDNA, 20 pmoles of each primers, 5 µL of 10×PCR Buffer, 5 µL of 2.5 mM dNTP mix and 1.0 unit of PfuTaq DNA polymerase. PCR was carried out In Thermal Cycler (Applied Biosystems) using the following conditions: initial denaturation for 5 min at 95° C. followed by 35 cycles of denaturation at 95° C. for 30 sec, annealing at 59-61° C. for 30 sec and extension at 72° C. for 1 to 2.0 min depending on the length of the targeted gene, with a final extension at 72° C. for 7 min. The PCR product was analyzed by 1% agarose gel using 1×TAE buffer and the amplicon was eluted from the gel using QIAGEN gel extraction kit following the manufacturer's instructions. The purified PCR product was ligated into pCR®8/GW/TOPO® TA cloning kit (Invitrogen) and transformed into competent *E. coli* cells (Invitrogen). Plasmids were isolated from putative colonies using QIAprip Spin Miniprep Kit (QIAGEN) following the manufacturer's instructions. The presence of the insert was checked by using the gene specific primers and positive plasmids were subjected to sequencing.

Example 4 Analysis of the Sequence

The nucleotide sequence and the amino acid sequence were analyzed by BLASTN and BLASTP programs respectively. The sequences reported from other plants were aligned with ClustalW. Phylogenetic analysis was carried out using the Neighbour Joining (NJ).

```
SEQ ID NO: 1
LENGTH: 1159 (including 150 bp 5' UTR and 150 bp 3' UTR)
TYPE: DNA
ORGANISM: M. phaseolina
CTCCAGGGATCCTTTTCTCTTCACTGCCCATCAGTCGCTGTGCCTCTTTACCTTCTGCTTCCAAGCAAGTCCT

TCGCTGGTCGAACTCTCTTTTGCTCTTTCCATTATTCTTGTCGATATTTTCTGGATTCATACTCCCCAATCAA

CACCATGAAGGGTTTCCTCGCCATCCTGGCGACCGCCTCGGTCGTCTCCGCCCACGCCACCTGGCAGGAGCTC

TGGGTTGGCACTCAGGACAAGGTGAGCACTTGTGCTCGTCTGCCTCAGAGCAACAGCCCCGTCCAGGACGTCA

CCTCCAACGCCATGCGCTGCAACGCCAACCCCTCGGCCGCTTCTTCCACTTGCTCCGTTGCGGCAGGTGACAG

CCTGACCGTTGAGATGCACCAGCAGCCCAACGACCGCAGCTGCACCAACGAGGCCATCGGCGGCAACCACTTC

GGCCCGGTCATGATCTACATGTCCAAGGTGGCCGACGCCACCAAGAACGTAGGCGACGGCGACTGGTTCAAGG

TTGCCCAGGACACCTACAACGGCACCGAGGCTTCTTGGGGCACCGAGATCCTGAACGCCAATTGCGGCAAGAG

GGCCTTCACCGGTAAGCACTCGCAGGCCCCCCCCCCCTTTTTTCCCTTTTGCTGTTCTCCACCTCTTTTCTCC
```

CTCCTGAAAGAAGCGACCGAGGACAAGGGAAAGCGAAAGTGAGATGAACGCGAAGGAAATGCAGCGAACTGAC

CTTTTTATTTTCCTTCTACACACAGTCCCCAAGACTCTCGCAGCCGGCGATTACCTCGTCCGCGCCGAGGCCA

TTGCTCTGCACAGCGCAGGCAGCAAGGGCGGCGCGCAGTTCTACATGACCTGTTTCCAGGTCAAGGTCACGGG

CGGTGGCTCCGCGACGCCCAAAGGCGTCAAGTTCCCCGGCGCGTACAAGGACAGCGACCCCGGCATCCTGATC

AACATCTACCAGACCCCCCTGACCTACACCGCCCCGGGCCCTGACGTCTGGACTGGTTAAGCATGGGAGTTGT

TTCTTCCGAGAATTGGTTCTTGTATATACTATTAGCATGGGGTTGAGGTGGAGACGCAATGATACTTGATGCT

GGATGTGACTTGAGATTCGCCGTCGGTGATAAGTCATAACGGAGAGTGATGTGGAATGGAGTGC

SEQ ID NO: 2
LENGTH: 699
TYPE: DNA
ORGANISM: *M. phaseolina*
FEATURE NAME/KEY: CDS
LOCATION: (1)...(699)
atgaagggtttcctcgccatcctggcgaccgcctcggtcgtctccgcccacgccacctgg
 M  K  G  F  L  A  I  L  A  T  A  S  V  V  S  A  H  A  T  W caggagctctgggttggcactcaggacaaggtgagcacttgtgctcgtctgcctcagagc
 Q  E  L  W  V  G  T  Q  D  K  V  S  T  C  A  R  L  P  Q  S aacagcccgtccaggacgtcacctccaacgccatgcgctgcaacgccaaccctcggcc
 N  S  P  V  Q  D  V  T  S  N  A  M  R  C  N  A  N  P  S  A gcttcttccacttgctccgttgcggcaggtgacagcctgaccgttgagatgcaccagcag
 A  S  S  T  C  S  V  A  A  G  D  S  L  T  V  E  M  H  Q  Q cccaacgaccgcagctgcaccaacgaggccatcggcggcaaccacttcggcccggtcatg
 P  N  D  R  S  C  T  N  E  A  I  G  G  N  H  F  G  P  V  M atctacatgtccaaggtggccgacgccaccaagaacgtaggcgacggcgactggttcaag
 I  Y  M  S  K  V  A  D  A  T  K  N  V  G  D  G  D  W  F  K gttgcccaggacacctacaacggcaccgaggcttcttggggcaccgagatcctgaacgcc
 V  A  Q  D  T  Y  N  G  T  E  A  S  W  G  T  E  I  L  N  A aattgcggcaagagggccttcaccgtccccaagactctcgcagccggcgattacctcgtc
 N  C  G  K  R  A  F  T  V  P  K  T  L  A  A  G  D  Y  L  V cgcgccgaggccattgctctgcacagcgcaggcagcaagggcggcgcgcagttctacatg
 R  A  E  A  I  A  L  H  S  A  G  S  K  G  G  A  Q  F  Y  M acctgtttccaggtcaaggtcacgggcggtggctccgcgacgcccaaaggcgtcaagttc
 T  C  F  Q  V  K  V  T  G  G  G  S  A  T  P  K  G  V  K  F cccggcgcgtacaaggacagcgaccccggcatcctgatcaacatctaccagaccccctg
 P  G  A  Y  K  D  S  D  P  G  I  L  I  N  I  Y  Q  T  P  L acctacaccgccccgggccctgacgtctggactggttaa
 T  Y  T  A  P  G  P  D  V  W  T  G  -

SEQ ID NO: 3
LENGTH: 232
TYPE: PRT
ORGANISM: *M. phaseolina*
MKGFLAILATASVVSAHATWQELWVGTQDKVSTCARLPQSNSPVQDVTSNAMRCNANPSAASSTCSVAAGDSL

TVEMHQQPNDRSCTNEAIGGNHFGPVMIYMSKVADATKNVGDGDWFKVAQDTYNGTEASWGTEILNANCGKRA

FTVPKTLAAGDYLVRAEAIALHSAGSKGGAQFYMTCFQVKVTGGGSATPKGVKFPGAYKDSDPGILINIYQTP

LTYTAPGPDVWTG*

SEQ ID NO: 4
LENGTH: 1108 (including 150 bp 5' UTR and 150 bp 3' UTR)
TYPE: DNA
ORGANISM: *M. phaseolina*
ATGGCAATGCCGAAGATTACATGTTTCTAGAATCCAGTATATAAGACACTTCACTGCCCATCATGGTTTTGCT

CTCCAGTGCTGGACACAAGCTCACTTTCGATCATTACCCTTTACACCGCAGCCTTACATTCTTTCCACTTCCT

CACAATGAAGTTCTCCGCCACCCTCGCTGCTCTTGCTGCCGCGACCCTGAGCAGTGCTCATTGTAGGCTTTCA

-continued

```
CCAAGCTTTTTCGGCCTCCAACGAGACCTAACACTTCATAGACACCTTCCCCGCCTTGGTCAACGAGGGCCAG

GTTACTGAGGACTGGAAGTATGTCCGCATGACTTCCAACCACTACTCCCACGGCCCTGTCACCGACGTGACCT

CCCAAGACATCCGCTGCTACGAGGACCCGTCCAAACCCACCACCTCGACTCTGTCCGTCAAGGCTGGCAACAC

TCTCGGCTTCACCGTCGACCCTAACGTCTCCCACCCGGGTACTCTCCAGTTCTACATGGCAAAGGCCCCCAGC

GGAACCACGGCTGCCAACTTCAAGGGCGACGGCGACGTGTGGTTCAAGATCTTCGGCCAGGGTCCCAAGATTG

CCAACGGCCAGCTCTCGTGGCCTTCGCAAGGTTCGTGTTCACGTTAGCGCTATACCCTTAATCAATAGAACTA

ACAGTGCCCCCGCGCAGGTTTGAGCCAGGTCAACGTCACCATCCCCGAGTCCTTGCCCAACGGCGACTACCTC

TTCCGCGTCGAGCACATTGCCCTGCATAGCGCTGGAAGCCAGAATGGCGCCCAGTTCTACATCTCTTGCGGTC

AGATCACCGTCACCGGTGGCGGCAACGGCAACCCTAGCCCCAAGGTCGCCCTGCCCGGCGCGTACAAGGCCAC

GGACCCCGGTCTGCTCATCAACATCTACTACCCCGTGCCCACCAGCTACACCCTCCCCGGCCCAGCCGTCTGG

TCTGGTTAGAGCGTTGTCTCTGTTAGAGGATTTCAAGCAGGGCCATAAGGGAGCGGGAAGGCTGCTCGCGGCT

CTTCTCTTCACAGTAAATATTTGACACCGCTGCTATAAATGGATGAACATACTTTAACGACTTTGATCTTGGG

CATATTCTTTCGA

SEQ ID NO: 5
LENGTH: 696
TYPE: DNA
ORGANISM: M. phaseolina
FEATURE NAME/KEY: CDS
LOCATION: (1)...(696)
atgaagttctccgccaccctcgctgctcttgctgccgcgaccctgagcagtgctcattac
 M   K   F   S   A   T   L   A   A   L   A   A   A   T   L   S   S   A   H   Y accttccccgccttggtcaacgagggccaggttactgaggactggaagtatgtccgcatg
 T   F   P   A   L   V   N   E   G   Q   V   T   E   D   W   K   Y   V   R   M acttccaaccactactcccacggccctgtcaccgacgtgacctcccaagacatccgctgc
 T   S   N   H   Y   S   H   G   P   V   T   D   V   T   S   Q   D   I   R   C tacgaggacccgtccaaacccaccacctcgactctgtccgtcaaggctggcaacactctc
 Y   E   D   P   S   K   P   T   T   S   T   L   S   V   K   A   G   N   T   L ggcttcaccgtcgaccctaacgtctcccacccgggtactctccagttctacatggcaaag
 G   F   T   V   D   P   N   V   S   H   P   G   T   L   Q   F   Y   M   A   K gcccccagcggaaccacggctgccaacttcaagggcgacggcgacgtgtggttcaagatc
 A   P   S   G   T   T   A   A   N   F   K   G   D   G   D   V   W   F   K   I ttcggccagggtcccaagattgccaacggccagctctcgtggccttcgcaaggttttgagc
 F   G   Q   G   P   K   I   A   N   G   Q   L   S   W   P   S   Q   G   L   S caggtcaacgtcaccatccccgagtccttgcccaacggcgactacctcttccgcgtcgag
 Q   V   N   V   T   I   P   E   S   L   P   N   G   D   Y   L   F   R   V   E cacattgccctgcatagcgctggaagccagaatggcgcccagttctacatctcttgcggt
 H   I   A   L   H   S   A   G   S   Q   N   G   A   Q   F   Y   I   S   C   G cagatcaccgtcaccggtggcggcaacggcaaccctagccccaaggtcgccctgcccggc
 Q   I   T   V   T   G   G   G   N   G   N   P   S   P   K   V   A   L   P   G gcgtacaaggccacggaccccggtctgctcatcaacatctactaccccgtgcccaccagc
 A   Y   K   A   T   D   P   G   L   L   I   N   I   Y   Y   P   V   P   T   S tacaccctccccggcccagccgtctggtctggttag
 Y   T   L   P   G   P   A   V   W   S   G   -

SEQ ID NO: 6
LENGTH: 231
TYPE: PRT
ORGANISM: M. phaseolina
MKFSATLAALAAATLSSAHYTFPALVNEGQVTEDWKYVRMTSNHYSHGPVTDVTSQDIRCYEDPSKPTTSTLS

VKAGNTLGFTVDPNVSHPGTLQFYMAKAPSGTTAANFKGDGDVWFKIFGQGPKIANGQLSWPSQGLSQVNVTI

PESLPNGDYLFRVEHIALHSAGSQNGAQFYISCGQITVTGGGNGNPSPKVALPGAYKATDPGLLINIYYPVPT

SYTLPGPAVWSG*
```

SEQ ID NO: 7
LENGTH: 1086 (including 150 bp 5' UTR and 150 bp 3' UTR)
TYPE: DNA
ORGANISM: M. phaseolina
GCTCTCCACGGCTGGTCCAACCGACTTCATTCACTGCCTTCTACCGCTTTCGCTCTCGCTCTCTCTCCAGATT

CTCTCTTTCTCCCAGCGCTAGCCGCTCAGTCACCACTTTCTACCCACCAACCAACCAAACACACCCAAACCAGC

AAAAATGCACACCTCCGCTACTCTCTTCGCTGCCGGCGCTATGGTCGCCTCTGTTGCCGCCCACGGCCACGTT

TCCGCCATTGTGGTCAACGGCAAGAGCTTCCAGGGCTACGACCCCAGCTTCTCCTACCAGAACCCTGCCCCCA

AGGTCGCTGGCTGGACTGCCCAGAACCTCGACAACGGCTTCGTCGAGCCCAACTCCTTCAGCTCCGGCGACAT

CATCTGCCACAAGGAGGCCAAGCCCGGCCAGGCCTACGTCGAGGCTGCCGCCGGCGACGAGCTCCAGATCCAG

TGGAGCACCTGGCCCGACTCGCACAAGGGCCCCGTCATCGACTACCTTGCCAGCTGCGGCGGCGACTGCACCA

CCGCCGACAAGACCTCGCTCTCCTTCGTCAAGTTCCAGGCCAAGGGTCTCGTCTCCGGCAGCGCGCCCGGCAC

CTGGGCCACCGACGACCTGATCTCCAACAACTTCACGCACACGACCACCCTGCCCGCCAGCCTCGCCCCGGGC

AACTACGTCCTGCGCCACGAGATCATCGCGCTCCACTCGGCGGGCCAGGAGAACGGCGCGCAGGCCTACCCCC

AGTGCATCAACGTCAAGGTCACCGGCTCCGGCAGCACCGAGATCTCCGGCGGCAAGAAGGCCACCGCCTTCTA

CACCCCCGACCGACCCCGGCATCAAGTTCAACCTCTACACCACCTTCTCCGAGTACCCCATGCCCGGTCCCGCT

CTCTGGTCCGCCGCCGCTGCCAAGGTCCGCCGCCACATGCGCGACTTCCGCCTCTTCTAAGCGGATCGCGTTC

TTCTGTTTTCACTTGTCAATATTGTTAGGAAGCAGCTTTTCTGTGAATACTGTTTAACTGGAATGAGATGGAA

AGAGCAAGGGGGAGGGTGTCATGGTGGATTGTGGTTGAGAGCTATTGAAAGAGAGGACTTCTTC

SEQ ID NO: 8
LENGTH: 786
TYPE: DNA
ORGANISM: M. phaseolina
FEATURE NAME/KEY: CDS
LOCATION: (1)...(786)

```
atgcacacctccgctactctcttcgctgccggcgctatggtcgcctctgttgccgcccac
 M  H  T  S  A  T  L  F  A  A  G  A  M  V  A  S  V  A  A  H ggccacgtttccgccattgtggtcaacggcaagagcttccagggctacgaccccagcttc
 G  H  V  S  A  I  V  V  N  G  K  S  F  Q  G  Y  D  P  S  F tcctaccagaaccctgcccccaaggtcgctggctggactgcccagaacctcgacaacggc
 S  Y  Q  N  P  A  P  K  V  A  G  W  T  A  Q  N  L  D  N  G ttcgtcgagcccaactccttcagctccggcgacatcatctgccacaaggaggccaagccc
 F  V  E  P  N  S  F  S  S  G  D  I  I  C  H  K  E  A  K  P ggccaggcctacgtcgaggctgccgccggcgacgagctccagatccagtggagcacctgg
 G  Q  A  Y  V  E  A  A  A  G  D  E  L  Q  I  Q  W  S  T  W cccgactcgcacaagggccccgtcatcgactaccttgccagctgcggcggcgactgcacc
 P  D  S  H  K  G  P  V  I  D  Y  L  A  S  C  G  G  D  C  T accgccgacaagacctcgctctccttcgtcaagttccaggccaagggtctcgtctccggc
 T  A  D  K  T  S  L  S  F  V  K  F  Q  A  K  G  L  V  S  G agcgcgcccggcacctgggccaccgacgacctgatctccaacaacttcacgcacacgacc
 S  A  P  G  T  W  A  T  D  D  L  I  S  N  N  F  T  H  T  T accctgcccgccagcctcgccccgggcaactacgtcctgcgccacgagatcatcgcgctc
 T  L  P  A  S  L  A  P  G  N  Y  V  L  R  H  E  I  I  A  L cactcggcgggccaggagaacggcgcgcaggcctaccccccagtgcatcaacgtcaaggtc
 H  S  A  G  Q  E  N  G  A  Q  A  Y  P  Q  C  I  N  V  K  V accggctccggcagcaccgagatctccggcggcaagaaggccaccgccttctacaccccg
 T  G  S  G  S  T  E  I  S  G  G  K  K  A  T  A  F  Y  T  P accgaccccggcatcaagttcaacctctacaccaccttctccgagtaccccatgcccggt
 T  D  P  G  I  K  F  N  L  Y  T  T  F  S  E  Y  P  M  P  G cccgctctctggtccgccgccgctgccaaggtccgccgccacatgcgcgacttccgcctc
 P  A  L  W  S  A  A  A  A  K  V  R  R  H  M  R  D  F  R  L ttctaa
 F  -
```

SEQ ID NO: 9
LENGTH: 261
TYPE: PRT
ORGANISM: M. phaseolina
MHTSATLFAAGAMVASVAAHGHVSAIVVNGKSFQGYDPSFSYQNPAPKVAGWTAQNLDNGFVEPNSFSSGDII

CHKEAKPGQAYVEAAAGDELQIQWSTWPDSHKGPVIDYLASCGGDCTTADKTSLSFVKFQAKGLVSGSAPGTW

ATDDLISNNFTHTTTLPASLAPGNYVLRHEIIALHSAGQENGAQAYPQCINVKVTGSGSTEISGGKKATAFYT

PTDPGIKFNLYTTFSEYPMPGPALWSAAAAKVRRHMRDFRLF*

SEQ ID NO: 10
LENGTH: 1283 (including 150 bp 5' UTR and 150 bp 3' UTR)
TYPE: DNA
ORGANISM: M. phaseolina
AAGCCACGACCTTTGCTTGAAAGATTTGCTTCTTCAGCTCAGGTTCTCACATTCATTCTTTTCACATTATCTG

CATTTGCGGCTAGCCCGTAGCCTTCTCTCTTTCTACCCACCATTCGTTGACCTACCTTCACTATCATCGCTGG

CAAGATGAAGTTCTCCCAATTCACTATTGCGGCCCTTGCGCCTCTTGTCTCAGCTCACTACTTCTTCGATACC

CTCGTCATTGATGGCCAGGAAACGCAAAGCATGCAATACGTCCGGTCCAACACTCGCCAAGCCAAGTACAACC

CGACCAAGTGGAAAAACACCCGTGACGACATGACACCTGATATGGACGACTTTCGCTGCAATAAGGGGGCTTT

CACGTTTGCCGGTTCAACTGGAACCGCCGAGGTCAAGGCTGGGTCGAAGCTTGCCATGAAGCTTGCCGTTGGA

GCTACTATGCAACATCCTGGCGCTGCTCTTGTCTACATGTCCAAAGCGCCTTCCGCCGCGAACTCCTATGAAG

GAGACGGAGAATGGTTCAAGATTTTTGAGGAAAGTGTCTGCAATCAGAATGGGGACTTTACGCGTGATGCCTG

GTGCACTTGGGACAAAGATCGTATCGAGTTCACCATTCCCGCCGACACCCCTGACGGAGAATATCTGATCCGC

CCTGAGCATGTCGGTAAGTTTCCACTTCTGTCCCTACTTATTTGACCACCTGACTGACATTTGTACAGCCGTT

CATGGAGCTCATGTTGGTGAGGCCGAGTTCTACTATGGGTAAGCTCTTCAGCACCTTACCCGGCAAGAAGAAG

TATAGTCTGACTCTCTGCAGCTGTGCCCAGGTCAAGGTTACCGGGGGTGGCAATGGTGTACCTGGTCCCACCG

TCAAGTTCCCTGGAGCGTACAAGAGCACCGACGAGTCATTCAATTTCAGTATCTACGGTGGCTACAAGCCATA

CCCTATGCCTGGTCCTGCTGTCTGGACTGGGGGCAACAGTGGGAGCAGCAGCGGTAACACCACAACCGCAAAC

AGCATAGATACCGCCAGCGCCGATCCCAGTGCTGAGGAaaCGTACTCCTGCAGCCGCGTTAAGCTGCCCCGTA

ACAGTCGCTCCTTCAGGGACTCTCTGCGTGAAGACTAAGCGAAGGACACCGTGCTTCCAGTGCCCTGCAGCTG

CATGCATCGACGACATGGGCTTTTATATCCCTTCTCCGGCCGACATCACAAACATTGAAGAAAGCATTTGAGG

TACGGTTGATGGACGGTCGGCGGCGGAAACAGGGTATCAAAT

SEQ ID NO: 11
LENGTH: 873
TYPE: DNA
ORGANISM: M. phaseolina
FEATURE NAME/KEY: CDS
LOCATION: (1)...(873)
atgaagttctcccaattcactattgcggcccttgcgcctcttgtctcagctcactacttc
 M   K   F   S   Q   F   T   I   A   A   L   A   P   L   V   S   A   H   Y   F ttcgataccctcgtcattgatggccaggaaacgcaaagcatgcaatacgtccggtccaac
 F   D   T   L   V   I   D   G   Q   E   T   Q   S   M   Q   Y   V   R   S   N actcgccaagccaagtacaacccgaccaagtggaaaaacacccgtgacgacatgacacct
 T   R   Q   A   K   Y   N   P   T   K   W   K   N   T   R   D   D   M   T   P gatatggacgactttcgctgcaataaggggGCTTTcacgtttgccggttcaactggaacc
 D   M   D   D   F   R   C   N   K   G   A   F   T   F   A   G   S   T   G   T gccgaggtcaaggctgggtcgaagcttgccatgaagcttgccgttggagctactatgcaa
 A   E   V   K   A   G   S   K   L   A   M   K   L   A   V   G   A   T   M   Q catcctggcgctgctcttgtctacatgtccaaagcgccttccgccgcgaactcctatgaa
 H   P   G   A   A   L   V   Y   M   S   K   A   P   S   A   A   N   S   Y   E ggagacggagaatggttcaagatttttgaggaaagtgtctgcaatcagaatggggacttt
 G   D   G   E   W   F   K   I   F   E   E   S   V   C   N   Q   N   G   D   F acgcgtgatgcctggtgcacttgggacaaagatcgtatcgagttcaccattcccgccgac
 T   R   D   A   W   C   T   W   D   K   D   R   I   E   F   T   I   P   A   D

```
acccctgacggagaatatctgatccgccctgagcatgtcgccgttcatggagctcatgtt
 T  P  D  G  E  Y  L  I  R  P  E  H  V  A  V  H  G  A  H  V ggtgaggccgagttctactatggctgtgcccaggtcaaggttaccggggtggcaatggt
 G  E  A  E  F  Y  Y  G  C  A  Q  V  K  V  T  G  G  G  N  G gtacctggtcccaccgtcaagttccctggagcgtacaagagcaccgacgagtcattcaat
 V  P  G  P  T  V  K  F  P  G  A  Y  K  S  T  D  E  S  F  N ttcagtatctacggtggctacaagccatacctatgcctggtcctgctgtctggactggg
 F  S  I  Y  G  G  Y  K  P  Y  P  M  P  G  P  A  V  W  T  G ggcaacagtgggagcagcagcggtaacaccacaaccgcaaacagcatagataccgccagc
 G  N  S  G  S  S  S  G  N  T  T  T  A  N  S  I  D  T  A  S gccgatcccagtgctgaggaaacgtactcctgcagccgcgttaagctgccccgtaacagt
 A  D  P  S  A  E  E  T  Y  S  C  S  R  V  K  L  P  R  N  S cgctccttcagggactctctgcgtgaagactaa
 R  S  F  R  D  S  L  R  E  D  -

SEQ ID NO: 12
LENGTH: 290
TYPE: PRT
ORGANISM: M. phaseolina
MKFSQFTIAALAPLVSAHYFFDTLVIDGQETQSMQYVRSNTRQAKYNPTKWKNTRDDMTPDMDDFRCNKGAFT

FAGSTGTAEVKAGSKLAMKLAVGATMQHPGAALVYMSKAPSAANSYEGDGEWFKIFEESVCNQNGDFTRDAWC

TWDKDRIEFTIPADTPDGEYLIRPEHVAVHGAHVGEAEFYYGCAQVKVTGGGNGVPGPTVKFPGAYKSTDESF

NFSIYGGYKPYPMPGPAVWTGGNSGSSSGNTTTANSIDTASADPSAEETYSCSRVKLPRNSRSFRDSLRED*

SEQ ID NO: 13
LENGTH: 1670 (including 150 bp 5' UTR and 150 bp 3' UTR)
TYPE: DNA
ORGANISM: M. phaseolina
GGATGTTCACTGCTTTCTCCGTCTATCCTCATTAGCCAGATAAATACGCGATCCGCCGTGTTGTCACTCAGAT

GCCTCGTCCTTCTCCAAATCACTGATCGGCAGCGCCGTGGCCTTTTTTGTTCCTCCCCACTGTCTTCAGTCTC

CACCATGCGGTCTATTCTGTCCACTTGCGCGCTGGTCGCCGCTGCTTCCGCGCACACCATTTTCCAGGAGCTC

TATGTCAACGGCGTGTCTCAGGGGCACACTACCGGCATTCGCGTGCCTGAATACGACGGGTATGATGCTTAGC

TATTTTTCTTGTCTCCGTCTATCCACACAGCCTCAGCCCCTCCGACTCGTGTTTAAACACTCCGAGCATCCGC

AAAGTGCCGATCGGCCACTAACATCAACTACTGCCAGCCCTATCACCGACGTCACCTCCAACGATGTCATCTG

TAACGGCGGGGTTAACCCCTTGAGGACTCCACTGCCGAGCGCTGTCATTGACGTATGTCTGCCTTTCCTCTTT

TTAGCCTCCGCGACCTTCATCTCCGCCTCAAACGCCAAGCTTCACCAGTGCATGACATGTACCGCTAGCGAGC

CTAGGACATTCTCCTGGCGAGTCCGCTTCGGAGAATCATGACAAGTGCAGCCAAGCATCGACAAAAACCTACC

TCTGCCCCACGCTCTCCGACTGTAAACAATACATTTGAGTCAGCAAAAACAGTCGGGACGGGAAAGAGATCAG

TCATGGCATACATGAGAAAGGAGTCGGAGCATTTCGCCCCGGGCGTTAACGAGAGGAAACGTCCGAGGCGCTC

ACGTCCGGTGGAAAGCTCCTTTTCCCATCAAGCGCCTTCTCTGCTCGGCGCAGCGGTGATCTGGGAAACCAAA

ACACGCTGAACACTTCCCAATCCGGCACGTGCAGAGAGCCTCATCCCGCGCACATACTGCTACCTCAAACACC

ACTACCACTCCACCCACACAATCAACCAAGCTCGCGTCCCCTAACCGACTTCCAGGTTCCCGCCGGCGCCAGC

GTGACCGCCGAGTTCCACCACACCCTGAAGGGCCTCGACCCGTCCGACGGCGACGACCCGATCAGCGCCTCGC

ACAAAGGCCCCATCATAGCGTACCTGGCCAAAGTGCCTGACGCGAAGCAGACCACGGTCACCGGCCTCTCGTG

GTTCAAGATCTACGCCGATGGGCTGGACGGCAGCTCGGGCACGTGGCGGTCGACAAGCTGATCAAGAACAAG

GGCAAGGTCAGCTTCGCCATCCCCAAGTGCATCCCGGCGGGCAACTACCTGCTGCGCGTCGAGCTGATTGCCC

TGCACGGCGCGAGCTCCTACCCGGGCGCCCAGCTGTACATGGAGTGCGCCCAGATCAACGTCACCGGCGGCAC

CGGCTCCAGCGTTCCCAGCGGCGTTCCGCTTCCCCGGCGCCTACAAGACTAACGATCCCGGTATCTTGTTTAAC

TTGTACTACCCCACCCCCACGACGTACACTATCCCTGGCCCTACTGTGCTCAAGTGCTAGAGAGCCTGCTGCG
```

CCTCTTGGCTTTGCAAGTGCTTTTTGAGGGAGAGGGAAGAATGAGTGGCGGGGAGAGGGTTGTTATCCGTCTT

GTGAATGCTTCATCTTGATTGAGCCTGGCCAGAACAGAAGCAGTGCATTTTCTGTAAATACTTT

SEQ ID NO: 14
LENGTH: 732
TYPE: DNA
ORGANISM: M. phaseolina
FEATURE NAME/KEY: CDS
LOCATION: (1)...(732)

```
atgcggtctattctgtccacttgcgcgctggtcgccgctgcttccgcgcacaccattttc
 M   R   S   I   L   S   T   C   A   L   V   A   A   A   S   A   H   T   I   F caggagctctatgtcaacggcgtgtctcaggggcacactaccggcattcgcgtgcctgaa
 Q   E   L   Y   V   N   G   V   S   Q   G   H   T   T   G   I   R   V   P   E tacgacggccctatcaccgacgtcacctccaacgatgtcatctgtaacggcggggttaac
 Y   D   G   P   I   T   D   V   T   S   N   D   V   I   C   N   G   G   V   N cccttgaggactccactgccgagcgctgtcattgacgttcccgccggcgccagcgtgacc
 P   L   R   T   P   L   P   S   A   V   I   D   V   P   A   G   A   S   V   T gccgagttccaccacaccctgaagggcctcgacccgtccgacggcgacgacccgatcagc
 A   E   F   H   H   T   L   K   G   L   D   P   S   D   G   D   D   P   I   S gcctcgcacaaaggccccatcatagcgtacctggccaaagtgcctgacgcgaagcagacc
 A   S   H   K   G   P   I   I   A   Y   L   A   K   V   P   D   A   K   Q   T acggtcaccggcctctcgtggttcaagatctacgccgatgggctggacggcagctcgggc
 T   V   T   G   L   S   W   F   K   I   Y   A   D   G   L   D   G   S       G acgtgggcggtcgacaagctgatcaagaacaagggcaaggtcagcttcgccatccccaag
 T   W   A   V   D   K   L   I   K   N   K   G   K   V   S   F   A   I   P   K tgcatcccggcgggcaactacctgctgcgcgtcgagctgattgccctgcacggcgcgagc
 C   I   P   A   G   N   Y   L   L   R   V   E   L   I   A   L   H   G   A   S tcctacccgggcgcccagctgtacatggagtgcgcccagatcaacgtcaccggcggcacc
 S   Y   P   G   A   Q   L   Y   M   E   C   A   Q   I   N   V   T   G   G   T ggctccagcgttcccagcggcgtccgcttccccggcgcctacaagactaacgatcccggt
 G   S   S   V   P   S   G   V   R   F   P   G   A   Y   K   T   N   D   P   G atcttgtttaacttgtactaccccaccccacgacgtacactatccctggccctactgtg
 I   L   F   N   L   Y   Y   P   T   P   T   T   Y   T   I   P   G   P   T   V ctcaagtgctag
 L   K   C   -
```

SEQ ID NO: 15
LENGTH: 243
TYPE: PRT
ORGANISM: M. phaseolina

MRSILSTCALVAAASAHTIFQELYVNGVSQGHTTGIRVPEYDGPITDVTSNDVICNGGVNPLRTPLPSAVIDV

PAGASVTAEFHHTLKGLDPSDGDDPISASHKGPIIAYLAKVPDAKQTTVTGLSWFKIYADGLDGSSGTWAVDK

LIKNKGKVSFAIPKCIPAGNYLLRVELIALHGASSYPGAQLYMECAQINVTGGTGSSVPSGVRFPGAYKTNDP

GILFNLYYPTPTTYTIPGPTVLKC*

SEQ ID NO: 16
LENGTH: 1196 (including 150 bp 5' UTR and 150 bp 3' UTR)
TYPE: DNA
ORGANISM: M. phaseolina

GTTACATATATACCAGCCGCAATGCCTTGTAGCTAGGGATCAGCTTCCCACTGCTAGCCAGTTCCTTCGCTCC

TACCAATCTTTGTTCTCATTCGTTTGACGGCCCGGTGCCTTTTTGAAGCCCTTATCCAATCCACTACAGCCAA

CACCATGTCTCTCAAGTCTCTCGCTATTCTCGCCGCTGGCGCGGCCTCCGTGAACGCCCACGGTGTCATTCTC

GACATCGTCTCCGCCGGCAAGGAGTACGGTGGTTGGGACGTCAACTACCAGTACTACAACCCGGTCCCTAAGG

TTGCTGCCTGGGCCGCCGGTGGCTACGGTCACGGTCCCATTGTCGGCACCCAGTACGCCAGCACCTCCATCAA

CTGTCACGATGACGCCAAGGCTGCTCCCATCTACATGGAGGCTGCTGCCGGTTCCGATATCGAGATCTCTTGG

GGCACCCCCGGCTCCAACCCCAGCCCCTGGGTAAGTTCCATCTCTTCCACGACATAGCCCTACCTGAGCCTCA

AGCTGACCGAAACTCACAGCCCGAATCGCACAAGGGCCCCATCATCACCTACATGGCGCCCTGCGGCACCGAT

-continued

```
GCCACCGGTGACTGCACGACCGTCCTGCCCGACGACCTCGGCTGGACCAAGGTCTACCAGACCGGTCTGCTGA

CCGGCGGCGACACCAGCGCCCAGGTCTGGGCCACCGACAAGCTCATCTCCGAGAACAAGACCACCGTCACCAT

CCCTTCGGCGCTGGCCCCCGGCAACTACGTCATGCGCCACGAGATCATCGCGCTCCACGCCGGCGGCGAGGTC

AACGGCCCCCAGAACTACCCCCAGTGCTACAACGTCAAGGTCACAGGCTCTGGTTCCGAGAAGCTGCCCGCCG

GTACCAAGGGCGTCAAGCTGTACGCACCTGAGGACACTGTTTTCAACATCTACGCAAACATCGACTCGTACCC

CTTCCCTGGCCCGGAACTTTGGAGCGGCGCTTCCAGCTCGTCGGGTGCTGGCGCTAACACCACTACTAAGCGT

TGGGCTCGTACCTTCAGGGGTTAAAGCGTTGTTCCGATGAAGGAAAATGGTGGTTGGGAAAGGAGAAAATACG

ATAGGACGTATTCTTGTAGATAtTTTTTTTTTAAACGCTTCGAACATTTCTTCCTATACATACTACTTTCTGA

GCGTGGGCGGTCCAGTGCCTCCCTTGTC
```

SEQ ID NO: 17
LENGTH: 834
TYPE: DNA
ORGANISM: M. phaseolina
FEATURE NAME/KEY: CDS
LOCATION: (1)...(834)

```
atgtctctcaagtctctcgctattctcgccgctggcgcggcctccgtgaacgcccacggt
 M  S  L  K  S  L  A  I  L  A  A  G  A  A  S  V  N  A  H  G gtcattctcgacatcgtctccgccggcaaggagtacggtggttgggacgtcaactaccag
 V  I  L  D  I  V  S  A  G  K  E  Y  G  G  W  D  V  N  Y  Q tactacaacccggtccctaaggttgctgcctgggccgccggtggctacggtcacggtccc
 Y  Y  N  P  V  P  K  V  A  A  W  A  A  G  G  Y  G  H  G  P attgtcggcacccagtacgccagcacctccatcaactgtcacgatgacgccaaggctgct
 I  V  G  T  Q  Y  A  S  T  S  I  N  C  H  D  D  A  K  A  A cccatctacatggaggctgctgccggttccgatatcgagatctcttggggcaccccggc
 P  I  Y  M  E  A  A  A  G  S  D  I  E  I  S  W  G  T  P  G tccaaccccagccctggcccgaatcgcacaagggccccatcatcacctacatggcgccc
 S  N  P  S  P  W  P  E  S  H  K  G  P  I  I  T  Y  M  A  P tgcggcaccgatgccaccggtgactgcacgaccgtcctgcccgacgacctcggctggacc
 C  G  T  D  A  T  G  D  C  T  T  V  L  P  D  D  L  G  W  T aaggtctaccagaccggtctgctgaccggcggcgacaccagcgcccaggtctgggccacc
 K  V  Y  Q  T  G  L  L  T  G  G  D  T  S  A  Q  V  W  A  T gacaagctcatctccgagaacaagaccaccgtcaccatcccttcggcgctggcccccggc
 D  K  L  I  S  E  N  K  T  T  V  T  I  P  S  A  L  A  P  G aactacgtcatgcgccacgagatcatcgcgctccacgccggcggcgaggtcaacggcccc
 N  Y  V  M  R  H  E  I  I  A  L  H  A  G  G  E  V  N  G  P cagaactaccccagtgctacaacgtcaaggtcacaggctctggttccgagaagctgccc
 Q  N  Y  P  Q  C  Y  N  V  K  V  T  G  S  G  S  E  K  L  P gccggtaccaagggcgtcaagctgtacgcacctgaggacactgttttcaacatctacgca
 A  G  T  K  G  V  K  L  Y  A  P  E  D  T  V  F  N  I  Y  A aacatcgactcgtaccccttccctggcccggaactttggagcggcgcttccagctcgtcg
 N  I  D  S  Y  P  F  P  G  P  E  L  W  S  G  A  S  S  S  S ggtgctggcgctaacaccactactaagcgttgggctcgtaccttcagggggttaa
 G  A  G  A  N  T  T  T  K  R  W  A  R  T  F  R  G  -
```

SEQ ID NO: 18
LENGTH: 277
TYPE: PRT
ORGANISM: M. phaseolina

MSLKSLAILAAGAASVNAHGVILDIVSAGKEYGGWDVNYQYYNPVPKVAAWAAGGYGHGPIVGTQYASTSINC

HDDAKAAPIYMEAAAGSDIEISWGTPGSNPSPWPESHKGPIITYMAPCGTDATGDCTTVLPDDLGWTKVYQTG

LLTGGDTSAQVWATDKLISENKTTVTIPSALAPGNYVMRHEIIALHAGGEVNGPQNYPQCYNVKVTGSGSEKL

PAGTKGVKLYAPEDTVFNIYANIDSYPFPGPELWSGASSSSGAGANTTTKRWARTFRG*

SEQ ID NO: 19
LENGTH: 1837 (including 150 bp 5' UTR and 150 bp 3' UTR)
TYPE: DNA
ORGANISM: M. phaseolina

TTCATCACCCTCGGCCAACAACAGTCACCTGCCGCTTCCCCTGTCCGAGCTCTCGTCAAGTCGTTGCCCACTG

CTTTTTCGCTGCACATATTAGCCCGCTGATCGAGCATTGAACTTCCTCACCAGTACGCTCTGCTTTGATCAAT

CAACATGAAAATCTTCGCTGTCACTTTGGCCCTGGCTGCTTCGACCGTCGTCGAAGCCCACACCATCTTCACC

ACTCTGTGGGTCGACGGCAAGTCCGTAGGCGATGGTGTTGGCGTCCGCATGCGCAAGACTCCCAAGACCGCCA

GCTTCCCTATCAGCCTCGGCGATGATGCCATGGCCTGTGGTTACGATGGCGAGGAGGGCAACCCGCGTGTCGT

GCCCGTCAACGACGGCGCCACCTTGTCCTTCGAGTGGCGCGCCTATGGCAGCAATCCCAGCAAGGGCGCTATT

GATGCTGGCCACAAGGGCCCCTGTGCTGTCTACCTGAAGAAGGTTGACTCCGCTGTCAACGACACTGGTAAGA

AACACTTCAGAATTCGACGCGGTTGTAGTGCTGACATACTACAGGCGTCGGCGATGGATGGTTCAAGGTTTGG

GATCAAGGATACGATGAGAAGAAGGGCCTGTGGTGCAATCAGATGCTGGGAGACCAGGATGAGAACGGTGTCT

ACAACCACAAGATTTCCATCGATCTCCCAAAGGGCCTTGAAGGTGGTTATTACCTTGCCCGTCCTGAGCTGCT

AGCCCTGCACTCAGCAGTCGCGAACCCTCCGGACCCCCAGTTCTACACTGGCTGCGCGCAGATCTTTCTCCAA

TCTACCGGCAACAAGCATCCCCAGGATACGGTTAGCATCCCTGGCTACATCAAGTCCACCGATGCTAGCGTCA

CCTTCAACATCTACAAGGAGCCATTGGAACTGCCTTACCTTACTCCGGGCCCTCCCGTCGCTGCACTCGTCAG

CGGTGGTGCTACTGCAGCCGAGGCTAGACAGGGCACCCAACAGGAAGGGCTGCAGCCGGATGGTTGCATTATG

GAGATGGCTGGTTTCTGCGCCTACGAGGTTCCATCATACACAGATGAGACTGGCTGCTGGGCTGTAAGTCATG

CTTTCCATCCTAACCTTCGATTCCCGCCGCTCACCGTCCAATCTAGTCTGGAGAAGAGTGCTGGGCTCAGCAC

AAGAAGTGCTGGGACTACTCGGAGACCATTCCCACTGGTGGCGACCCCTGGTGCACTCTTTGGGGTGACAAGT

GTCAGAACATCGACGACAACTGCAATGCAAAGAATTTCAACGGGCCACCCAACGCAAACAAGGTGTTGACTCC

TCAGCTCCCTACAATGGCCAGCATCCCCATGGCTCTTTCGACCACCAACTACGAGTCTACTACTGCCGCGTCC

GCGTCCGCCGCCGCCGTGAATGCTGACAGCGAGGCCTCGTCTGCTTCTGAGCCGAGCTACGCCGCCCCAACCA

CGACACTTCTCACCCTTTCCAGCTCCAGCGCCAAATCCGAGACATCGGCTTCATCCACCGAGGTTGAAGCTTC

CCCGAGCACGGCAACTTCGTACACCACAGCTGCGCCTGCTGTCAAGACTACTTACGAGACTGCCTTCGTGACG

GAAATTGTGTATATTACCGCTGGTGCGAAGAACAAGAGGCGCTCCAGACACTTCGGCAGGCACGGGGTGAAGC

CGTCGTAGATGCTAGTGCTGTTTCATGAGTGGAGCTCCTGCGCGGTTCGGACGGAGGGTTTCACTGCCCACCT

GCTTTTCTGATCCAGGTATCATCTGGCATGTGTAGGCGTAGGTTGCTCAGCCGGACATGAGCATCTTCTTTTC

TCCAAAAACCTT

SEQ ID NO: 20
LENGTH: 1431
TYPE: DNA
ORGANISM: M. phaseolina
FEATURE NAME/KEY: CDS
LOCATION: (1)...(1431)

```
atgaaaatcttcgctgtcactttggccctggctgcttcgaccgtcgtcgaagcccacacc
 M   K   I   F   A   V   T   L   A   L   A   A   S   T   V   V   E   A   H   T atcttcaccactctgtgggtcgacggcaagtccgtaggcgatggtgttggcgtccgcatg
 I   F   T   T   L   W   V   D   G   K   S   V   G   D   G   V   G   V   R   M cgcaagactcccaagaccgccagcttccctatcagcctcggcgatgatgccatggcctgt
 R   K   T   P   K   T   A   S   F   P   I   S   L   G   D   D   A   M   A   C ggttacgatggcgaggagggcaacccgcgtgtcgtgcccgtcaacgacggcgccaccttg
 G   Y   D   G   E   E   G   N   P   R   V   V   P   V   N   D   G   A   T   L tccttcgagtggcgcgcctatggcagcaatcccagcaagggcgctattgatgctggccac
 S   F   E   W   R   A   Y   G   S   N   P   S   K   G   A   I   D   A   G   H aagggcccctgtgctgtctacctgaagaaggttgactccgctgtcaacgacactggcgtc
 K   G   P   C   A   V   Y   L   K   K   V   D   S   A   V   N   D   T   G   V
```

```
ggcgatggatggttcaaggtttgggatcaaggatacgatgagaagaagggcctgtggtgc
 G  D  G  W  F  K  V  W  D  Q  G  Y  D  E  K  K  G  L  W  C aatcagatgctgggagaccaggatgagaacggtgtctacaaccacaagatttccatcgat
 N  Q  M  L  G  D  Q  D  E  N  G  V  Y  N  H  K  I  S  I  D ctcccaaagggccttgaaggtggttattaccttgcccgtcctgagctgctagccctgcac
 L  P  K  G  L  E  G  G  Y  Y  L  A  R  P  E  L  L  A  L  H tcagcagtcgcgaaccctccggacccccagttctacactggctgcgcgcagatcttttctc
 S  A  V  A  N  P  P  D  P  Q  F  Y  T  G  C  A  Q  I  F  L caatctaccggcaacaagcatccccaggatacggttagcatccctggctacatcaagtcc
 Q  S  T  G  N  K  H  P  Q  D  T  V  S  I  P  G  Y  I  K  S accgatgctagcgtcaccttcaacatctacaaggagccattggaactgccttacttact
 T  D  A  S  V  T  F  N  I  Y  K  E  P  L  E  L  P  Y  L  T ccgggcccccccgtcgctgcactcgtcagcggtggtgctactgcagccgaggctagacag
 P  G  P  P  V  A  A  L  V  S  G  G  A  T  A  A  E  A  R  Q ggcacccaacaggaagggctgcagccggatggttgcattatggagatggctggtttctgc
 G  T  Q  Q  E  G  L  Q  P  D  G  C  I  M  E  M  A  G  F  C gcctacgaggttccatcatacacagatgagactggctgctgggcttctggagaagagtgc
 A  Y  E  V  P  S  Y  T  D  E  T  G  C  W  A  S  G  E  E  C tgggctcagcacaagaagtgctgggactactcggagaccattcccactggtggcgacccc
 W  A  Q  H  K  K  C  W  D  Y  S  E  T  I  P  T  G  G  D  P tggtgcactctttggggtgacaagtgtcagaacatcgacgacaactgcaatgcaaagaat
 W  C  T  L  W  G  D  K  C  Q  N  I  D  D  N  C  N  A  K  N ttcaacgggccacccaacgcaaacaaggtgttgactcctcagctccctacaatggccagc
 F  N  G  P  P  N  A  N  K  V  L  T  P  Q  L  P  T  M  A  S atccccatggctctttcgaccaccaactacgagtctactactgccgcgtccgcgtccgcc
 I  P  M  A  L  S  T  T  N  Y  E  S  T  T  A  A  S  A  S  A gccgccgtgaatgctgacagcgaggcctcgtctgcttctgagccgagctacgccgcccca
 A  A  V  N  A  D  S  E  A  S  S  A  S  E  P  S  Y  A  A  P accacgacacttctcacccttccagctccagcgccaaatccgagacatcggcttcatcc
 T  T  T  L  L  T  L  S  S  S  S  A  K  S  E  T  S  A  S  S accgaggttgaagcttccccgagcacggcaacttcgtacaccacagctgcgcctgctgtc
 T  E  V  E  A  S  P  S  T  A  T  S  Y  T  T  A  A  P  A  V aagactacttacgagactgccttcgtgacggaaattgtgtatattaccgctggtgcgaag
 K  T  T  Y  E  T  A  F  V  T  E  I  V  Y  I  T  A  G  A  K aacaagaggcgctccagacacttcggcaggcacggggtgaagccgtcgtag
 N  K  R  R  S  R  H  F  G  R  H  G  V  K  P  S  -

SEQ ID NO: 21
LENGTH: 476
TYPE: PRT
ORGANISM: M. phaseolina
MKIFAVTLALAASTVVEAHTIFTTLWVDGKSVGDGVVRMRKTPKTASFPISLGDDAMACGYDGEEGNPRVVP

VNDGATLSFEWRAYGSNPSKGAIDAGHKGPCAVYLKKVDSAVNDTGVGDGWFKVWDQGYDEKKGLWCNQMLGD

QDENGVYNHKISIDLPKGLEGGYYLARPELLALHSAVANPPDPQFYTGCAQIFLQSTGNKHPQDTVSIPGYIK

STDASVTFNIYKEPLELPYLTPGPPVAALVSGGATAAEARQGTQQEGLQPDGCIMEMAGFCAYEVPSYTDETG

CWASGEECWAQHKKCWDYSETIPTGGDPWCTLWGDKCQNIDDNCNAKNFNGPPNANKVLTPQLPTMASIPMAL

STTNYESTTAASASAAAVNADSEASSASEPSYAAPTTTLLTLSSSSAKSETSASSTEVEASPSTATSYTTAAP

AVKTTYETAFVTEIVYITAGAKNKRRSRHFGRHGVKPS*

SEQ ID NO: 22
LENGTH: 1158 (including 150 bp 5' UTR and 150 bp 3' UTR)
TYPE: DNA
ORGANISM: M. phaseolina
TTGGCACTGGCGAGCGCGCGGGTTCGCGCTCAATATATAGGGGATGCTGTTACTCTGGGTTCCAAGACTGGGC

AAGGCGTTCCGCTTGCTTCTCGATTTCCAGATACCCAGAGCAGTAAAGCTTGATCCATTCCAGAAAACAAACG

AAAGATGCGGTCGGGGAACATTGCGGCAGGCCTCTTGCCTGTTTGGGCTAGCCTGAGTGCCATGGTGCACGCT
```

```
CACGGGTGCGTCCCTACATTCTCTCCCACCAAAGACCGGTCCCAGACGCGGCTGCAAGAAGGTTGTTGACTTG

GCCGAGATGCTGACCATCCGATCGCCAGCCACGTCCAATACCACGTCATGAACTCGGCCACCTACACCGGCTA

CCTCCCCGTCAAGACCCCCGACTTCACCGCCGACCCGCCCAGCATCGTGCGCAGGGTCGGCGGCAACGGGCCG

GTGCTCGACATCGGCACGTCCAACATCACCTGCAACGTCGGCGCGGCGCCCATCGCCGACGCGGACGGCCGCT

CGCGCACGGGCGCCGTGACGGCGGGCACCAACATCACCTTCCTGTGGAACGAGTGGCCGCACTCCGGGCCGGT

GCTGACGTACATGGCCAAGTGCGAGCCGGACTGCGGCTCCTTCACCGGCAGCGACGGGCCGTGTGGTTCAAG

ATCGACGAGTGGGGCTACCGCGACGGCGTGTGGGGTCGCAGAAGCTGGTCGACGACGGCAACAGCTGGACGA

GCACCGTGCCCGCGTGCCTGGCGCCCGGCGAGTACCTCGTCCGGCACGAGATCATCGCGCTGTCCGACTGCAA

GACGCAGGGCAAGTGCCAGTTCTATCCCAGCTGCGCGCAGGTCACCGTCGAGGGCGACGGCACCGCGGCGCCG

GCCGGCGACAGCGTCATTGCGCTGCCCGGCGGCTACAAGACGGATGGGACGGGCATTCTGTGGGACACGAACA

AGCAGAAGCCGGCCGACTACGTGACTCCGGGGCCCGCGGTCTTCCAGTGCCCCAGCTGAGCGGAGGAGGTGGA

AGTGCGCGCTGAACGGCATGTGGGATGATGATCGAGGGGGCGGTATTTGTTCACTTCTTGGGACATATTATTT

TTGAAGACCAATCTGGCATTGAACGACTATGAAACACAAGATACTTCTTGGTGCAATCTGGCT
```

```
SEQ ID NO: 23
LENGTH: 762
TYPE: DNA
ORGANISM: M. phaseolina
FEATURE NAME/KEY: CDS
LOCATION: (1)...(762)
atgcggtcggggaacattgcggcaggcctcttgcctgtttgggctagcctgagtgccatg
 M   R   S   G   N   I   A   A   G   L   L   P   V   W   A   S   L   S   A   M gtgcacgctcacggccacgtccaataccacgtcatgaactcggccacctacaccggctac
 V   H   A   H   G   H   V   Q   Y   H   V   M   N   S   A   T   Y   T   G   Y ctccccgtcaagacccccgacttcaccgccgacccgcccagcatcgtgcgcagggtcggc
 L   P   V   K   T   P   D   F   T   A   D   P   P   S   I   V   R   R   V   G ggcaacgggccggtgctcgacatcggcacgtccaacatcacctgcaacgtcggcgcggcg
 G   N   G   P   V   L   D   I   G   T   S   N   I   T   C   N   V   G   A   A cccatcgccgacgcggacggccgctcgcgcacgggcgccgtgacggcgggcaccaacatc
 P   I   A   D   A   D   G   R   S   R   T   G   A   V   T   A   G   T   N   I accttcctgtggaacgagtggccgcactccgggccggtgctgacgtacatggccaagtgc
 T   F   L   W   N   E   W   P   H   S   G   P   V   L   T   Y   M   A   K   C gagccggactgcggctccttcaccggcagcgacgggccgtgtggttcaagatcgacgag
 E   P   D   C   G   S   F   T   G   S   D   A   V   W   F   K   I   D   E tggggctaccgcgacggcgtgtggggtcgcagaagctggtcgacgacggcaacagctgg
 W   G   Y   R   D   G   V   W   G   S   Q   K   L   V   D   D   G   N   S   W acgagcaccgtgcccgcgtgcctggcgcccggcgagtacctcgtccggcacgagatcatc
 T   S   T   V   P   A   C   L   A   P   G   E   Y   L   V   R   H   E   I   I gcgctgtccgactgcaagacgcagggcaagtgccagttctatcccagctgcgcgcaggtc
 A   L   S   D   C   K   T   Q   G   K   C   Q   F   Y   P   S   C   A   Q   V accgtcgagggcgacggcaccgcggcgccggccggcgacagcgtcattgcgctgcccggc
 T   V   E   G   D   G   T   A   A   P   A   G   D   S   V   I   A   L   P   G ggctacaagacggatgggacgggcattctgtgggacacgaacaagcagaagccggccgac
 G   Y   K   T   D   G   T   G   I   L   W   D   T   N   K   Q   K   P   A   D tacgtgactccggggcccgcggtcttccagtgccccagctga
 Y   V   T   P   G   P   A   V   F   Q   C   P   S   -
```

```
SEQ ID NO: 24
LENGTH: 253
TYPE: PRT
ORGANISM: M. phaseolina
MRSGNIAAGLLPVWASLSAMVHAHGHVQYHVMNSATYTGYLPVKTPDFTADPPSIVRRVGGNGPVLDIGTSNI

TCNVGAAPIADADGRSRTGAVTAGTNITFLWNEWPHSGPVLTYMAKCEPDCGSFTGSDAVWFKIDEWGYRDG
```

VWGSQKLVDDGNSWTSTVPACLAPGEYLVRHEIIALSDCKTQGKCQFYPSCAQVTVEGDGTAAPAGDSVIALP

GGYKTDGTILWDTNKQKPADYVTPGPAVFQCPS*

SEQ ID NO: 25
LENGTH: 1413 (including 150 bp 5' UTR and 150 bp 3' UTR)
TYPE: DNA
ORGANISM: M. phaseolina
TTCTTTCACCGGTCTCCGACCAACCACATTCTTTCCACCAAGATCATTCTTCACTGCGTGAAGCTGGGATCTT

CTTTATCGCTTTGACAGCAGCCTATCTCTTCGTTCAGCCAACCAACACAGTCTTTTCACCCTCCCCTACCCCT

TGCCATGTCTGCTATCTTCAAGAACGCCGGTCTGCTCGGCGCCCTCGCCGCCACCGCCGCTGCCCACGGCACC

GTTTCGGGCATTGTCATCGATGGCAAATACACCCAGAACTACAACCCCTCCATGCAGTACCAGTCTCCTGCTC

CCGTCGTCATCGGCTGGGCCATCCCCGAGGATCAGGACAACGGCTTCGTCGCCCCTCGGCCTACTCTGACCC

CGACATCATCTGCCACAAGGGTGCTTCCAACGCCCAGACCTACGCTACCGTTGCTGCTGGCGAGAAGATCGAC

ATCGAGTGGACCACCTGGCCCGACTCGCACAAGGGCCCCGTCATTTCCTACCTCGCCCCCTGCGGTGGTGACT

GCACCACCGTCGACAAGGAGACGCTCAAGTTCGTCAAGATCGACCAGGGTGGCCTCAACGTGGACACCCAGAC

CTGGGCTGCCACCGACCTGATTGCCAACAACAACACCTGGGTCACCACCATTCCGTCCAGCGTCGCGCCCGGC

AAGTACGTCCTCCGCCACGAGATCATCGCTCTCCACAGCGCCGGCTCCGCCGACGGTGCCCAGAACTACCCCC

AGTGCATGAACCTCGAGATCACCGGCTCCGGCTCCGACGACCTGACCACCGGCGGCACCCTCGGCACCGCCCT

GTACAAGGAGGACGACCCGGGCATCCTCATCAACATCTACCAGACCCTCTCCACCTACGAGATCCCCGGCCCC

ACCCTCTACTCGGGCGCCTCGTCGGGCTCTGCCACCGCCGTCGCCAGCTCCGCCGCTGCTTCCACCCCGGCTG

CTACCTCCGCCGTTGCCTCGTCGGCCGCTGCCACCAGCACCGCCGTCGCCGCCGCTGACGTCTCTACCACCTC

CGCCGCCAGCACCCCGACTGACCTGACTGCCGTCGTCCCCAGCTCCGTCCTGTCCGTCCAGGCCACCGCCATC

CCCACCGCCTCGGGCGTCGCCGTCCCCGAGACCAGCGTCCCCGACGACTTCACCGTCAAGGACATCCTTCAGT

GGTTCGCCTACGTCATGGAGACCTACTTCACCAAGGACTCGAGCTCCTCCTCCGCTAAGGTCCGCCGTCACGC

CCGTGACGTCAAGCTCAACTAAGCGCGAGCGGAGAGCATGGAAAACGCTTACGAAGGAAATGTTTCTTTTTCC

TTGAGCAGGAGATGCGCATGTATTTGTGACCTGACTGGCAAAACTCTTTGATATTCTTTTGGCTGAACTGAGA

GATGTTCTGCTGTTTTTACATACCTT

SEQ ID NO: 26
LENGTH: 1113
TYPE: DNA
ORGANISM: M. phaseolina
FEATURE NAME/KEY: CDS
LOCATION: (1)...(1113)
atgtctgctatcttcaagaacgccggtctgctcggcgccctcgccgccaccgccgctgcc
 M   S   A   I   F   K   N   A   G   L   L   G   A   L   A   A   T   A   A   A cacggcaccgtttcgggcattgtcatcgatggcaaatacacccagaactacaacccctcc
 H   G   T   V   S   G   I   V   I   D   G   K   Y   T   Q   N   Y   N   P   S atgcagtaccagtctcctgctcccgtcgtcatcggctgggccatccccgaggatcaggac
 M   Q   Y   Q   S   P   A   P   V   V   I   G   W   A   I   P   E   D   Q   D aacggcttcgtcgcccctcggcctactctgaccccgacatcatctgccacaagggtgct
 N   G   F   V   A   P   S   A   Y   S   D   P   D   I   I   C   H   K   G   A tccaacgcccagacctacgctaccgttgctgctggcgagaagatcgacatcgagtggacc
 S   N   A   Q   T   Y   A   T   V   A   A   G   E   K   I   D   I   E   W   T acctggcccgactcgcacaagggccccgtcatttcctacctcgcccctgcggtggtgac
 T   W   P   D   S   H   K   G   P   V   I   S   Y   L   A   P   C   G   G   D tgcaccaccgtcgacaaggagacgctcaagttcgtcaagatcgaccagggtggcctcaac
 C   T   T   V   D   K   E   T   L   K   F   V   K   I   D   Q   G   G   L   N gtggacacccagacctgggctgccaccgacctgattgccaacaacaacacctgggtcacc
 V   D   T   Q   T   W   A   A   T   D   L   I   A   N   N   N   T   W   V   T accattccgtccagcgtcgcgcccggcaagtacgtcctccgccacgagatcatcgctctc
 T   I   P   S   S   V   A   P   G   K   Y   V   L   R   H   E   I   I   A   L

```
cacagcgccggctccgccgacggtgcccagaactaccccagtgcatgaacctcgagatc
 H  S  A  G  S  A  D  G  A  Q  N  Y  P  Q  C  M  N  L  E  I accggctccggctccgacgacctgaccaccggcggcaccctcggcaccgccctgtacaag
 T  G  S  G  S  D  D  L  T  T  G  G  T  L  G  T  A  L  Y  K gaggacgacccgggcatcctcatcaacatctaccagaccctctccacctacgagatcccc
 E  D  D  P  G  I  L  I  N  I  Y  Q  T  L  S  T  Y  E  I  P ggccccaccctctactcgggcgcctcgtcgggctctgccaccgccgtcgccagctccgcc
 G  P  T  L  Y  S  G  A  S  S  G  S  A  T  A  V  A  S  S  A gctgcttccaccccggctgctacctccgccgttgcctcgtcggccgctgccaccagcacc
 A  A  S  T  P  A  A  T  S  A  V  A  S  S  A  A  A  T  S  T gccgtcgccgccgctgacgtctctaccacctccgccgccagcacccccgactgacctgact
 A  V  A  A  A  D  V  S  T  T  S  A  A  S  T  P  T  D  L  T gccgtcgtcccagctccgtcctgtccgtccaggccaccgccatccccaccgcctcgggc
 A  V  V  P  S  S  V  L  S  V  Q  A  T  A  I  P  T  A  S  G gtcgccgtccccgagaccagcgtccccgacgacttcaccgtcaaggacatccttcagtgg
 V  A  V  P  E  T  S  V  P  D  D  F  T  V  K  D  I  L  Q  W ttcgcctacgtcatggagacctacttcaccaaggactcgagctcctcctccgctaaggtc
 F  A  Y  V  M  E  T  Y  F  T  K  D  S  S  S  S  A  K  V cgccgtcacgcccgtgacgtcaagctcaactaa
 R  R  H  A  R  D  V  K  L  N  -

SEQ ID NO: 27
LENGTH: 370
TYPE: PRT
ORGANISM: M. phaseolina
MSAIFKNAGLLGALAATAAAHGTVSGIVIDGKYTQNYNPSMQYQSPAPVVIGWAIPEDQDNGFVAPSAYSDPD

IICHKGASNAQTYATVAAGEKIDIEWTTWPDSHKGPVISYLAPCGGDCTTVDKETLKFVKIDQGGLNVDTQTW

AATDLIANNNTWVTTIPSSVAPGKYVLRHEIIALHSAGSADGAQNYPQCMNLEITGSGSDDLTTGGTLGTALY

KEDDPGILINIYQTLSTYEIPGPTLYSGASSGSATAVASSAAASTPAATSAVASSAAATSTAVAAADVSTTSA

ASTPTDLTAVVPSSVLSVQATAIPTASGVAVPETSVPDDFTVKDILQWFAYVMETYFTKDSSSSAKVRRHAR

DVKLN*

SEQ ID NO: 28
LENGTH: 1106 (including 150 bp 5' UTR and 150 bp 3' UTR)
TYPE: DNA
ORGANISM: M. phaseolina
GAGGTGCGGGTACTCTTTACCCGTGAAACATGCGTCACCTCGTGGCCAGCGGTCTGAACTTCCGGGACAGATA

AAGAGGGATGCGTTTCCCGTGGATATTTCCATCAACAGTCTTGGCTGCTCCTTTCAATATCACTTCCCAGCGC

GAACATGAAGACCTTTGCAACTTTCGCTCTTGCTGCTTCTGTGCTGGCACAGACTGTCAGCGGACACTGTAAG

ATGCACCTTGGGGATGGAGGCCCATCTGAAGAATCACGAACTCATCGCTGACGCCCATTTCCACAGACATCTT

TGAGTACCTCACCGCCAACGGTGTTAAGGGAGGAGCGTACCAGAACATCAGGCAGAACACGAACAACAACTCG

CCTGTGACAGATCTCGCCTCCAACGACCTCCGTTGCAACGTCGGCGGCGCTGATGGTAGCAAGACTAGCACGG

TCTCAGTGGCCGCCGGCAGCTCGGTCAGCTTCACTGCAGACATTGCTGTCTACCACCAGGGCCCTACTTCGTT

CTACATGACCAAAGTCGCCGACGCCTCGAAGGCGGACGGCAGTACCCCGTGGTTTAAGATCAAGGACATTGGA

CCGACCGTAAGCCATATTCAAGACCCCTAGCAAAAAGTATCCGTCAGCTAACGCATCGCCAGTTCTCTAACG

GTCAAGCAACCTGGGATCTTGGAACCACTTACTCCGTGACTATTCCCAACTGCCTTCCGGCTGGCGAATACCT

GCTGCGTATTCAACAGCTTGCAATCCACAACCCTTGGCCGGCGGGAATTCCTCAGTTCTACATTTCTTGCGCT

CAGGTGAAGGTGACCGGTAGCGGTTCTGGCTCACCCAGCCCAACCGTTTCTATCCCTGGCGCCTTCAAGAACA

CTGACCCGGGTTACACGGTCAACATCTACAACAACTTCAACAATTACACGGTTCCCGGTCCGGCGGTCTGGAA

GTGCTAGATGGAACAGACGTGAAACGCCGGTTACGCTGGAAGGGGCGTGGTGGGATTGCCGGTTGGCCAAA

TGGCAGAAACTCCAGTTGTGTATAGTGGCCACCTTCTTCAATGGACATACTTATCGTAACTCGTCACTTTCAA

TCGTCACTGTG
```

SEQ ID NO: 29
LENGTH: 678
TYPE: DNA
ORGANISM: M. phaseolina
FEATURE NAME/KEY: CDS
LOCATION: (1)...(678)
atgaagacctttgcaactttcgctcttgctgcttctgtgctggcacagactgtcagcgga
 M   K   T   F   A   T   F   A   L   A   A   S   V   L   A   Q   T   V   S   G cactacatctttgagtacctcaccgccaacggtgttaagggaggagcgtaccagaacatc
 H   Y   I   F   E   Y   L   T   A   N   G   V   K   G   G   A   Y   Q   N   I aggcagaacacgaacaacaactcgcctgtgacagatctcgcctccaacgacctccgttgc
 R   Q   N   T   N   N   N   S   P   V   T   D   L   A   S   N   D   L   R   C aacgtcggcggcgctgatggtagcaagactagcacggtctcagtggccgccggcagctcg
 N   V   G   G   A   D   G   S   K   T   S   T   V   S   V   A   A   G   S   S gtcagcttcactgcagacattgctgtctaccaccagggccctacttcgttctacatgacc
 V   S   F   T   A   D   I   A   V   Y   H   Q   G   P   T   S   F   Y   M   T aaagtcgccgacgcctcgaaggcggacggcagtaccccgtggtttaagatcaaggacatt
 K   V   A   D   A   S   K   A   D   G   S   T   P   W   F   K   I   K   D   I ggaccgaccttctctaacggtcaagcaacctgggatcttggaaccacttactccgtgact
 G   P   T   F   S   N   G   Q   A   T   W   D   L   G   T   T   Y   S   V   T attcccaactgccttccggctggcgaatacctgctgcgtattcaacagcttgcaatccac
 I   P   N   C   L   P   A   G   E   Y   L   L   R   I   Q   Q   L   A   I   H aacccttggccggcgggaattcctcagttctacatttcttgcgctcaggtgaaggtgacc
 N   P   W   P   A   G   I   P   Q   F   Y   I   S   C   A   Q   V   K   V   T ggtagcggttctggctcacccagcccaaccgtttctatccctggcgccttcaagaacact
 G   S   G   S   G   S   P   S   P   T   V   S   I   P   G   A   F   K   N   T gacccgggttacacggtcaacatctacaacaacttcaacaattacacggttcccggtccg
 D   P   G   Y   T   V   N   I   Y   N   N   F   N   N   Y   T   V   P   G   P gcggtctggaagtgctag
 A   V   W   K   C   -

SEQ ID NO: 30
LENGTH: 225
TYPE: PRT
ORGANISM: M. phaseolina
MKTFATFALAASVLAQTVSGHYIFEYLTANGVKGGAYQNIRQNTNNNSPVTDLASNDLRCNVGGADGSKTSTV

SVAAGSSVSFTADIAVYHQGPTSFYMTKVADASKADGSTPWFKIKDIGPTFSNGQATWDLGTTYSVTIPNCLP

AGEYLLRIQQLAIHNPWPAGIPQFYISCAQVKVTGSGSGSPSPTVSIPGAFKNTDPGYTVNIYNNFNNYTVPG

PAVWKC*

SEQ ID NO: 31
LENGTH: 1028 (including 150 bp 5' UTR and 150 bp 3' UTR)
TYPE: DNA
ORGANISM: M. phaseolina
AGCTTTGTCCTGTTAGCTGACAATAGTCTGACTGCTCGACAGACCTGCTGAGCTGGTCAATATTTAAAGACAA

TGCTGGCTCCTCCTGTGAGGAGACAGCAAATCTGTCAGCACTATTCTCAGCTCCATTCTCCCTTGAAGTAATT

CACCATGTTCTCTCCGCTCTGGGCCCTGTCGGCTCTGCTCCTATTTCCTGCCACTGAAGCCACTAGCGGCGTG

ACAACCAGGTACTGGGACTGCTGCAAGCCGTCTTGTGCTTGGACGGGCAAAGCATCCGTCTCCAAGCCCGTCG

GAACCTGCGACATCAACGACAACGCCCAGACGCCGAGCGATCTGCTCAAGTCGTCCTGTGATGGCGGCAGCGC

CTACTACTGCAGCAACCAGGGCCCATGGGCCGTGAACGCACAGCCTTTCCTACGGCTTCGCTGCCGCCAAGCTG

TCCGGAAAGCAGGAGACTGATTGGTGCTGTGGCTGCTACAAGTAAGCAAAGACCCGTCTTCCTTCACAACCCC

TTAATTCCTTTACTAACGTCTGCAAAGACTCACATTCACCTCCACCGCCGTTTCCGGCAAGCAAATGATCGTG

CAAATCACGAACACGGGCGGCGACCTCGGCAACAACCACTTCGACATCGCCATGCCGGGCGGCGGCGTCGGCA

TCTTCAACGGGTGCTCCAAGCAATGGAACGGCATCAATCTGGGCAACCAGTATGGCGGCTTCACTGACCGCTC

GCAATGTGCGACGCTCCCGTCCAAGTGGCAGGCCAGCTGCAACTGGCGCTTCGACTGGTTCGAGAATGCCGAC

AACCCCACCGTCGATTGGGAGCCTGTCACTTGCCCACAGGAATTGGTCGCCCGGACTGGCTGTTCCCGTACCT

AAGTGGGGGTGGAACCTCCATGTGAATTGGTGTATATAGCTCCTGCCTGAGCATCCACCAGTTCGCATGTGTT

GATCAGGAGTTGTGTTGCCTTGCTAGGAAAGACTTTGTTGGAAACTTGCGTGTTTATTCCAATTGAATAACCC

TGTATA

SEQ ID NO: 32
LENGTH: 669
TYPE: DNA
ORGANISM: M. phaseolina
FEATURE NAME/KEY: CDS
LOCATION: (1)...(669)

```
atgttctctccgctctgggccctgtcggctctgctcctatttcctgccactgaagccact
 M  F  S  P  L  W  A  L  S  A  L  L  L  F  P  A  T  E  A  T agcggcgtgacaaccaggtactgggactgctgcaagccgtcttgtgcttggacgggcaaa
 S  G  V  T  T  R  Y  W  D  C  C  K  P  S  C  A  W  T  G  K gcatccgtctccaagcccgtcggaacctgcgacatcaacgacaacgcccagacgccgagc
 A  S  V  S  K  P  V  G  T  C  D  I  N  D  N  A  Q  T  P  S gatctgctcaagtcgtcctgtgatggcggcagcgcctactactgcagcaaccagggccca
 D  L  L  K  S  S  C  D  G  G  S  A  Y  Y  C  S  N  Q  G  P tgggccgtgaacgacagcctttcctacggcttcgctgccgccaagctgtccggaaagcag
 W  A  V  N  D  S  L  S  Y  G  F  A  A  A  K  L  S  G  K  Q gagactgattggtgctgtggctgctacaaactcacattcacctccaccgccgtttccggc
 E  T  D  W  C  C  G  C  Y  K  L  T  F  T  S  T  A  V  S  G aagcaaatgatcgtgcaaatcacgaacacgggcggcgacctcggcaacaaccacttcgac
 K  Q  M  I  V  Q  I  T  N  T  G  G  D  L  G  N  N  H  F  D atcgccatgccgggcggcggcgtcggcatcttcaacgggtgctccaagcaatggaacggc
 I  A  M  P  G  G  G  V  G  I  F  N  G  C  S  K  Q  W  N  G atcaatctgggcaaccagtatggcggcttcactgaccgctcgcaatgtgcgacgctcccg
 I  N  L  G  N  Q  Y  G  G  F  T  D  R  S  Q  C  A  T  L  P tccaagtggcaggccagctgcaactggcgcttcgactggttcgagaatgccgacaacccc
 S  K  W  Q  A  S  C  N  W  R  F  D  W  F  E  N  A  D  N  P accgtcgattgggagcctgtcacttgcccacaggaattggtcgcccggactggctgttcc
 T  V  D  W  E  P  V  T  C  P  Q  E  L  V  A  R  T  G  C  S cgtacctaa
 R  T  -
```

SEQ ID NO: 33
LENGTH: 222
TYPE: PRT
ORGANISM: M. phaseolina
MFSPLWALSALLLFPATEATSGVTTRYWDCCKPSCAWTGKASVSKPVGTCDINDNAQTPSDLLKSSCDGGSAY

YCSNQGPWAVNDSLSYGFAAAKLSGKQETDWCCGCYKLTFTSTAVSGKQMIVQITNTGGDLGNNHFDIAMPGG

GVGIFNGCSKQWNGINLGNQYGGFTDRSQCATLPSKWQASCNWRFDWFENADNPTVDWEPVTCPQELVARTGC

SRT*

SEQ ID NO: 34
LENGTH: 1410 (including 150 bp 5' UTR and 150 bp 3' UTR)
TYPE: DNA
ORGANISM: M. phaseolina
TCCATCAGACATGATTCAACATCTGCATTTCATATAAATAAGTGAGCGTCTGCTGCTCCCACTTTCTTTGTTC

TCCAAGCCCAGCTGCTCGCTCCCGCCTTGCCATTCCTTTCTTCATACCTGCCGATCGCTTCATTCTTTACCTT

CATCATGCGTCTTTCCACTCTTCTTATTGCCGGTTCGGCCTCCCTCGCGCTGGCTGCGCCAGTGCAAAGGAA

GAGAAGCGTGCTTCCAACTTCCAATTCTTCGGTGTCAACGAGTCCGGTCCTGAGTTTGGCGAGACCAAGCTTC

CCGGTACCAAGAACACTGACTATGTCTGGCCCACTCTTTCCACTATTGATACCTTCGTCGGCAAGGGAATGAA

CACTTTCCGTGTCAATATCCTGATGGAACGTCTGACTCACAACTCCCTGACCGCCTCCCTCGACTCTCAGTAC

CTGGCAGACTTGAAGACAACGGTCAACTACATCACCGGCAAGGGTGCCTACGCCATGATCGTCCCCCACAACT

ATGGCCGTAAGCTTGTCTTACCCAACACGTGTCAAGATACCTTTACTCACAGCATCTCCAGGCTTCAACTCGC

AGATCATCACCGACACCGCGGGTTTCAAGACTTGGTGGACCAACGTCGCCAAGGAATTCGCCGGCAACAGCAA

-continued

AGTCATCTTCGACATCAACAACGAGTTCCACGACATGGACCAGACCCTTGTCGTCAACCTTAACCAGGCTGGT

ATCGACGGTATCCGTGCTGCTGGTGCTACCAGCCAGTACATCACGGCTGAGGGCAACTCGTGGACTGGTGCCT

GGACTTGGACGACCTCCGAGAACGGCAAAACCATGGCTGCTCTCAAGGATCCCCAGAACAAGCTCATCTACCA

GATGCACCAGTACCTCGACAGCGATGGCAGCGGCACTAACGAGGCTTGCGTCTCCAGCACCATCGGCAAGGAG

CGTATCACGGCCGCTACCAAGTGGCTTAAGGATAACGGCAAGAAGGGCCTCATCGGAGAGTTTGCTGGCGGCA

ACAACAGCCAGTGCAAGACTGCCGTCGAGGGAATGCTCACTTATATGCAAGAGAACAAGGATGTCTGGACGGG

TGCCCTCTGGTGGGCTGCTGGACCATGGATAAGTCTTCCACCACCCCCTTTTGGAAAACATTCAGCTAACAAC

AGACGCACTGGGCCTCTTACATGTACAGCATGGAGCCTAAGACCGGAACCGCATACACTGCCTACCTTGACCT

CATCTCCAAATTCAAATAGATGATCGCCGTTTGCTGGCTGTCAGGTCGAATTCGTTTGCGAGGCGGGTTCTTG

CTTCGATTGTATATATTTTGATGACCGCTTCGCCGGGAAAaTTAAAAAAaGATATCTCTACTGAAACCCTTCA

ATTCTTGCATCGACCCCACAGGA

SEQ ID NO: 35
LENGTH: 963
TYPE: DNA
ORGANISM: *M. phaseolina*
FEATURE NAME/KEY: CDS
LOCATION: (1)...(963)

```
atgcgtctttccactcttcttattgccggttcggcctccctcgcgctggctgcgccagtg
 M   R   L   S   T   L   L   I   A   G   S   A   S   L   A   L   A   A   P   V caaaaggaagagaagcgtgcttccaacttccaattcttcggtgtcaacgagtccggtcct
 Q   K   E   E   K   R   A   S   N   F   Q   F   F   G   V   N   E   S   G   P gagtttggcgagaccaagcttcccggtaccaagaacactgactatgtctggcccactctt
 E   F   G   E   T   K   L   P   G   T   K   N   T   D   Y   V   W   P   T   L tccactattgataccttcgtcggcaagggaatgaacactttccgtgtcaatatcctgatg
 S   T   I   D   T   F   V   G   K   G   M   N   T   F   R   V   N   I   L   M gaacgtctgactcacaactccctgaccgcctccctcgactctcagtacctggcagacttg
 E   R   L   T   H   N   S   L   T   A   S   L   D   S   Q   Y   L   A   D   L aagacaacggtcaactacatcaccggcaagggtgcctacgccatgatcgtcccccacaac
 K   T   T   V   N   Y   I   T   G   K   G   A   Y   A   M   I   V   P   H   N tatggccgcttcaactcgcagatcatcaccgacaccgcgggtttcaagacttggtggacc
 Y   G   R   F   N   S   Q   I   I   T   D   T   A   G   F   K   T   W   W   T aacgtcgccaaggaattcgccggcaacagcaaagtcatcttcgacatcaacaacgagttc
 N   V   A   K   E   F   A   G   N   S   K   V   I   F   D   I   N   N   E   F cacgacatggaccagacccttgtcgtcaaccttaaccaggctggtatcgacggtatccgt
 H   D   M   D   Q   T   L   V   V   N   L   N   Q   A   G   I   D   G   I   R gctgctggtgctaccagccagtacatcacggctgagggcaactcgtggactggtgcctgg
 A   A   G   A   T   S   Q   Y   I   T   A   E   G   N   S   W   T   G   A   W acttggacgacctccgagaacggcaaaaccatggctgctctcaaggatccccagaacaag
 T   W   T   T   S   E   N   G   K   T   M   A   A   L   K   D   P   Q   N   K ctcatctaccagatgcaccagtacctcgacagcgatggcagcggcactaacgaggcttgc
 L   I   Y   Q   M   H   Q   Y   L   D   S   D   G   S   G   T   N   E   A   C gtctccagcaccatcggcaaggagcgtatcacggccgctaccaagtggcttaaggataac
 V   S   S   T   I   G   K   E   R   I   T   A   A   T   K   W   L   K   D   N ggcaagaagggcctcatcggagagtttgctggcggcaacaacagccagtgcaagactgcc
 G   K   K   G   L   I   G   E   F   A   G   G   N   N   S   Q   C   K   T   A gtcgagggaatgctcacttatatgcaagagaacaaggatgtctggacgggtgccctctgc
 V   E   G   M   L   T   Y   M   Q   E   N   K   D   V   W   T   G   A   L   C atggagcctaagaccggaaccgcatacactgcctaccttgacctcatctccaaattcaaa
 M   E   P   K   T   G   T   A   Y   T   A   Y   L   D   L   I   S   K   F   K tag
 -
```

SEQ ID NO: 36
LENGTH: 320
TYPE: PRT
ORGANISM: M. phaseolina
MRLSTLLIAGSASLALAAPVQKEEKRASNFQFFGVNESGPEFGETKLPGTKNTDYVWPTLSTIDTFVGKGMNT

FRVNILMERLTHNSLTASLDSQYLADLKTTVNYITGKGAYAMIVPHNYGRFNSQIITDTAGFKTWWTNVAKEF

AGNSKVIFDINNEFHDMDQTLVVNLNQAGIDGIRAAGATSQYITAEGNSWTGAWTWTTSENGKTMAALKDPQN

KLIYQMHQYLDSDGSGTNEACVSSTIGKERITAATKWLKDNGKKGLIGEFAGGNNSQCKTAVEGMLTYMQENK

DVWTGALCMEPKTGTAYTAYLDLISKFK*

SEQ ID NO: 37
LENGTH: 1995 (including 150 bp 5' UTR and 150 bp 3' UTR)
TYPE: DNA
ORGANISM: M. phaseolina
CTAAACTCCTTGGCCCTTCACAAGATCTGCATGACCGCTTGTGCCCCGCAAGGTCTCGGGAAAATCATTCGAT

AGGCTGTTTAAGAATGGGCGTTCTCTGCAGTTCCGGGGGAATGCTGCGATCAACCTCTTGCACCGTCCTGATC

GCTAATGCACATGGCGACCGGCATCCTGAGAGTAGACGGCGAGAATGTCGTCGGCAACGATGGGAAACCTGTC

ATCCTTCGCGGCGCCGGCTTGGGAGGATGGATGAAGTGAGTGATGCTGTCCACCGTTACTGGCCTTGTATCGG

ATGTTGACTATCCACAGCATGGAGAACTTCATCACAGGCTATCCAGGCCACGAGCATCAACACCGCGCCGCCA

TGCTTAAGGTGCTCGGAAAGGAAAAGTATGAGTTCTTTTTTGACAAGTGGTTGGAGTATTTCTTCACCGAAAG

GGATGCCACCTTCTTCGCCAGCAAGGGCCTAAACTGCCTTCGACTGCCCTTCAACTACCGTCACTTTGAAGAC

GACATGAACCCGCGGGTGCTCAAGCAGTCCGGTTTCAAGCATCTCGACCGCGTCGTCGACCTGTGTGCAAAGC

ACAAAATCTACACGTAGGCAACTTCATTCCCAACATGAGAAATTGAGAAGAATCTGACACGCAACGGGCCGAC

CCAGCATCCTCGACATGCATACAGTACCGGGCGGCCAGAACGGCGACTGGCATTCGGACAATGTAACCAACTA

CGCCGCGTTCTGGGACTACAAGGACCACCAAGATCGCACCGTCTGGCTGTGGGAGCAAATTGCCCAGCGCTAC

AAGGATAATCCATGGGTTGCCGGCTATAATCCGATCAATGAGCCTTGCGACCCCcGAGCACTGGAGATTGCCTG

CATTCTATGATCGTATTGAGGCAGCCATCCGCAAAATTGATCCTAACCACATTTTGTGGCTGGATGGGAACAC

CTTTGCCATGGAGTGGAAGTACTTCGACAAGAAGCTGCCGAACACCGTCTACGCCCTGCATGACTACACGGTA

CAGACTGCCGTCGCCTTTTCACAAGCCATGTAACTGACATCTTCAGATGATGGGCTTCCCCAAAGGCGAGAAA

TTCATAGGCTCCGCCGAGCAAAAATCCAAACTCGAGCGCCAATTCGTTCGCAAGTGCGAATTCCACTACAAGT

TCCAGACGCCAATCTGGAACGGTAAATATCTGTGCCGCACCTCAACCAACGCCGCACTAACATGAACAGGGGA

GTTCGGCCCGGTCTACGCCAATCCGGAGCTCGACGAAGACCACTCCGACGTCAACGAGGCGCGCTACAACGTC

CTGTCCGAGCAGCTTAACATCTACGACAAGTACAAAATACACTGGAGCATCTGGCTGTACAAGGACATCGGCG

TGCAGGGCATGGTACACACTAGCCCTCAGAGCAAATGGAACCGCACCATCGCGCCGTTCCTGAAGCGCAAACG

CGAACTACAGCTCGATGCCTGGGGCCGCTATCCCAGCAAGCAGGTCGAGGACGTTATCAATCCGCTCGTCGAT

TGGATCGACAAGGTTGCGCCCACGAGCAAGTTGCAGTACCCTACGCCCTGGGCTACGGAGCGCCAGGTCACTC

GTCTGATCAATCAGATCTGGTTGTCTTCCTGCTTGCAAGACGAGTTTGCGGAGTTGTTTAGGGGTATGGGTTT

CGAGGAGTTGGAGGAGTGTGCTAAGAGCTTCGCTTTCGAGCGTTGCATCCAGCGCGAGGGCTTGAACAAGGCG

CTGGAGGATCACAGTGCGGTGCCCGAAGTTACCGCTGACTGGAAGCGTCCGGAGTTCCGCAAGTCAGACCCCA

ATGAGGCCATTGGTGTGTGAACAGTCTGGAAGCACGGAGTCAATTCTCGAAACAGATAATGCAAACTTAAGGC

CATTACAGGTTATCATTTCCGGCTATAGCATCCGTTTTCTACGAGAGTTAAACAATATATACTGCGCTTAGAT

ATGGCTAACATTGGACGGCGGGTG

SEQ ID NO: 38
LENGTH: 1479
TYPE: DNA
ORGANISM: M. phaseolina
FEATURE NAME/KEY: CDS
LOCATION: (1)...(1479)

```
atgcacatggcgaccggcatcctgagagtagacggcgagaatgtcgtcggcaacgatggg
 M  H  M  A  T  G  I  L  R  V  D  G  E  N  V  V  G  N  D  G aaacctgtcatccttcgcggcgccggcttgggaggatggatgaacatggagaacttcatc
 K  P  V  I  L  R  G  A  G  L  G  G  W  M  N  M  E  N  F  I acaggctatccaggccacgagcatcaacaccgcgccgccatgcttaaggtgctcggaaag
 T  G  Y  P  G  H  E  H  Q  H  R  A  A  M  L  K  V  L  G  K gaaaagtatgagttcttttttgacaagtggttggagtatttcttcaccgaaagggatgcc
 E  K  Y  E  F  F  F  D  K  W  L  E  Y  F  F  T  E  R  D  A accttcttcgccagcaagggcctaaactgccttcgactgcccttcaactaccgtcacttt
 T  F  F  A  S  K  G  L  N  C  L  R  L  P  F  N  Y  R  H  F gaagacgacatgaacccgcgggtgctcaagcagtccggtttcaagcatctcgaccgcgtc
 E  D  D  M  N  P  R  V  L  K  Q  S  G  F  K  H  L  D  R  V gtcgacctgtgtgcaaagcacaaaatctacaccatcctcgacatgcatacagtaccgggc
 V  D  L  C  A  K  H  K  I  Y  T  I  L  D  M  H  T  V  P  G ggccagaacggcgactggcattcggacaatgtaaccaactacgccgcgttctgggactac
 G  Q  N  G  D  W  H  S  D  N  V  T  N  Y  A  A  F  W  D  Y aaggaccaccaagatcgcaccgtctggctgtgggagcaaattgcccagcgctacaaggat
 K  D  H  Q  D  R  T  V  W  L  W  E  Q  I  A  Q  R  Y  K  D aatccatgggttgccggctataatccgatcaatgagccttgcgaccccgagcactggaga
 N  P  W  V  A  G  Y  N  P  I  N  E  P  C  D  P  E  H  W  R ttgcctgcattctatgatcgtattgaggcagccatccgcaaaattgatcctaaccacatt
 L  P  A  F  Y  D  R  I  E  A  A  I  R  K  I  D  P  N  H  I ttgtggctggatgggaacacctttgccatggagtggaagtacttcgacaagaagctgccg
 L  W  L  D  G  N  T  F  A  M  E  W  K  Y  F  D  K  K  L  P aacaccgtctacgccctgcatgactacacgatgatgggcttccccaaaggcgagaaattc
 N  T  V  Y  A  L  H  D  Y  T  M  M  G  F  P  K  G  E  K  F ataggctccgccgagcaaaaatccaaactcgagcgccaattcgttcgcaagtgcgaattc
 I  G  S  A  E  Q  K  S  K  L  E  R  Q  F  V  R  K  C  E  F cactacaagttccagacgccaatctggaacggggagttcggcccggtctacgccaatccg
 H  Y  K  F  Q  T  P  I  W  N  G  E  F  G  P  V  Y  A  N  P gagctcgacgaagaccactccgacgtcaacgaggcgcgctacaacgtcctgtccgagcag
 E  L  D  E  D  H  S  D  V  N  E  A  R  Y  N  V  L  S  E  Q cttaacatctacgacaagtacaaaatacactggagcatctggctgtacaaggacatcggc
 L  N  I  Y  D  K  Y  K  I  H  W  S  I  W  L  Y  K  D  I  G gtgcagggcatggtacacactagccctcagagcaaatggaaccgcaccatcgcgccgttc
 V  Q  G  M  V  H  T  S  P  Q  S  K  W  N  R  T  I  A  P  F ctgaagcgcaaacgcgaactacagctcgatgcctggggccgctatcccagcaagcaggtc
 L  K  R  K  R  E  L  Q  L  D  A  W  G  R  Y  P  S  K  Q  V gaggacgttatcaatccgctcgtcgattggatcgacaaggttgcgcccacgagcaagttg
 E  D  V  I  N  P  L  V  D  W  I  D  K  V  A  P  T  S  K  L cagtaccctacgccctgggctacggagcgccaggtcactcgtctgatcaatcagatctgg
 Q  Y  P  T  P  W  A  T  E  R  Q  V  T  R  L  I  N  Q  I  W ttgtcttcctgcttgcaagacgagtttgcggagttgtttaggggtatgggtttcgaggag
 L  S  S  C  L  Q  D  E  F  A  E  L  F  R  G  M  G  F  E  E ttggaggagtgtgctaagagcttcgctttcgagcgttgcatccagcgcgagggcttgaac
 L  E  E  C  A  K  S  F  A  F  E  R  C  I  Q  R  E  G  L  N aaggcgctggaggatcacagtgcggtgcccgaagttaccgctgactggaagcgtccggag
 K  A  L  E  D  H  S  A  V  P  E  V  T  A  D  W  K  R  P  E ttccgcaagtcagaccccaatgaggccattggtgtgtga
 F  R  K  S  D  P  N  E  A  I  G  V  -
```

-continued

SEQ ID NO: 39
LENGTH: 492
TYPE: PRT
ORGANISM: M. phaseolina
MHMATGILRVDGENVVGNDGKPVILRGAGLGGWMNMENFITGYPGHEHQHRAAMLKVLGKEKYEFFFDKWLEY

FFTERDATFFASKGLNCLRLPFNYRHFEDDMNPRVLKQSGFKHLDRVVDLCAKHKIYTILDMHTVPGGQNGDW

HSDNVTNYAAFWDYKDHQDRTVWLWEQIAQRYKDNPWVAGYNPINEPCDPEHWRLPAFYDRIEAAIRKIDPNH

ILWLDGNTFAMEWKYFDKKLPNTVYALHDYTMMGFPKGEKFIGSAEQKSKLERQFVRKCEFHYKFQTPIWNGE

FGPVYANPELDEDHSDVNEARYNVLSEQLNIYDKYKIHWSIWLYKDIGVQGMVHTSPQSKWNRTIAPFLKRKR

ELQLDAWGRYPSKQVEDVINPLVDWIDKVAPTSKLQYPTPWATERQVTRLINQIWLSSCLQDEFAELFRGMGF

EELEECAKSFAFERCIQREGLNKALEDHSAVPEVTADWKRPEFRKSDPNEAIGV*

SEQ ID NO: 40
LENGTH: 2095 (including 150 bp 5' UTR and 150 bp 3' UTR)
TYPE: DNA
ORGANISM: M. phaseolina
TGCCCTGCGGCGATTTTGCTCCCACCGGCTCTTCAAGTCTTGAGTCCCTCGTTGACTACTGTAGCTTTGCGGT

CTTTGCCCTGAGCATCTGGTCTTTGAGGGGATTCTTCGTTCGATCTTTCTTTTTGATTTTGCTACATCCTCCC

AACGATGAGGTCCTTCCTTTACGCTGCCGGTCTCGCGCAGCTGGGCCGTCTGGCCTCTGCGCTGCCTCTTTCG

GCTTACGCATCAGCGTCTGCCGCCACGTGCAATGGGACTTTCAACGCCATCACTGCTCAGCAATTTGTCGATC

GCATGAACCCGGGCTGGAACTTGGGAAACACGCTGGACGCGATTGAGGATGAGGGCGACTGGAACAACGcCCC

GGTTACTGAAGTTACCTTTGACGATGTCAAGAAGGCTGGCTTCAAGGGCATTCGTCTGCCTGGTAAGTATTCC

ATATGCCGTCTCAACTGTTCGTATTCTAACTCCATCTTCAGTCACTTGGGCATACCACTTTACCTCCGAGGCA

CCCGACTACACCGTTGACCCTGCTTGGCTGCAGCGTGTTGAGGATGTGGTTGACATGATCACTGCTCGTGATT

TCTACGCCATTGTCAACGTTCACCATGACAGCTGGAACTGGGCCGATATGACCGCCAGTGGAGCGAACTACAC

ACTCATTGAAGAGAAGTTCTATAAGCTTTGGTACCAGATTGGTGAGAAGCTCGCTTGCAAGTCTGAGCTAGTT

GCCTTCGAGCCCATCAACGAGCCTCCGGGTACCACTGCCGAGCACGGCGCTGAACTGAACAAGCTCAACAACA

TCTTCTTGAAGGCGATCAACGATGCTGGTGGATTCAACGCGCAGCGTGTGGTCACTCTCCCTGGTCTGGGGGA

GGACAGCATCAAGACCAGCACATGGTTCGAGCCGCCGAGCGCCAACTTCACCAACCCCTGGGCCATCCAGTAC

CACTACTACTCTCCTTACGACTTCATCTTCAGCGCCTGGGGCAAGACCAGGTGGGGTTCTGATGCGGACAAGG

CTGCTCTTGAGGCGGACATTGCCAATATCCGCAACAACTTTACTGATGTTCCTCTCATTATCGGCGAGTGGGC

CGCTTCGCCTGTGGCCACAGAGTCGGCAGCCCGCTGGAAGTACTTCGACTTCATCATCCGGACCGCCAAAAAG

TACAATACCTCCACTGTCCTTTGGGACAACGGCGCCGACTTCCTCGACCGCAACACCCATACCTGGCGCGATC

AGACTGCCATCGACATCTACCTGAACGCGGTCCAGGGCGTCGAGAACTCGCTGCCCGACAGCACCGAGGACGG

TCAGGCCACCAGCCAGTTCACCTCCGCCTACATCTGGCACCAGGTTGGCACCCCCGTGACCTCGCAGAGCCTG

CCTTTCCTCTTCAACGGCAACACTCTCTCCAGCGTCAGTGTCGGCGGCAACCCGCTCGCCGAGGGCAGCGACT

ACTCGACCAACGGCTCCAGCATCAGCTTCTCCGAATCCTTCCTGTCACAGCACCTCTCCGCCGACGCAGCGCC

TGGCGTCAAGGCCAACCTTACGCTCTCATTCTCTGCTGGCGCCGACATCGAAGTCCAGATCGTGCAGTGGGAC

GTCCCGACGCTCGCCACCAACGGCACCACGGCTGCGGCCGCCGACACCGGGTCGGACCTCCGCATCCCGATCA

CCTGGAAGGGCTTGAACAAGCCGGCAACGGTCAAGGCGCTGACAACGGACGGCACCATCCTCGTGGACGACTG

GACGCAGTACCTGGGCCCGCTCGAGAAGGCGCACATCACGTACAACAACCAGTGGAACTGGGACGCGTCGAAC

ATCCTGCTCACCAGCAGCGCCGTCAAGGCTGTCGTCAGCGCGGCCAAGACGACCGTCTTCACGATCGAATTCT

ACCCGCGCGTGCCGGGCAACGCGGTCAACTACACGCTTACGGTTTAGATGGGGAAACCCGCCCTGTGGAATGG

GCGGCACGACCGAAGGGACTCTTTTGACTTCTTGCATATAGCTTGGGGCATTCAAACTTCCGGACTTTCTTGT

ACATAGATTTTGCAAATTTGATGCTTGACGCAAGATTTGGAAGATGAGCGC

-continued

SEQ ID NO: 41
LENGTH: 1743
TYPE: DNA
ORGANISM: M. phaseolina
FEATURE NAME/KEY: CDS
LOCATION: (1)...(1743)

```
atgaggtccttcctttacgctgccggtctcgcgcagctgggccgtctggcctctgcgctg
 M  R  S  F  L  Y  A  A  G  L  A  Q  L  G  R  L  A  S  A  L cctctttcggcttacgcatcagcgtctgccgccacgtgcaatgggactttcaacgccatc
 P  L  S  A  Y  A  S  A  S  A  A  T  C  N  G  T  F  N  A  I actgctcagcaatttgtcgatcgcatgaacccgggctggaacttgggaaacacgctggac
 T  A  Q  Q  F  V  D  R  M  N  P  G  W  N  L  G  N  T  L  D gcgattgaggatgagggcgactggaacaacgccccggttactgaagttacctttgacgat
 A  I  E  D  E  G  D  W  N  N  A  P  V  T  E  V  T  F  D  D gtcaagaaggctggcttcaagggcattcgtctgcctgtcacttgggcataccactttacc
 V  K  K  A  G  F  K  G  I  R  L  P  V  T  W  A  Y  H  F  T tccgaggcacccgactacaccgttgaccctgcttggctgcagcgtgttgaggatgtggtt
 S  E  A  P  D  Y  T  V  D  P  A  W  L  Q  R  V  E  D  V  V gacatgatcactgctcgtgatttctacgccattgtcaacgttcaccatgacagctggaac
 D  M  I  T  A  R  D  F  Y  A  I  V  N  V  H  H  D  S  W  N tgggccgatatgaccgccagtggagcgaactacacactcattgaagagaagttctataag
 W  A  D  M  T  A  S  G  A  N  Y  T  L  I  E  E  K  F  Y  K ctttggtaccagattggtgagaagctcgcttgcaagtctgagctagttgccttcgagccc
 L  W  Y  Q  I  G  E  K  L  A  C  K  S  E  L  V  A  F  E  P atcaacgagcctccgggtaccactgccgagcacggcgctgaactgaacaagctcaacaac
 I  N  E  P  P  G  T  T  A  E  H  G  A  E  L  N  K  L  N  N atcttcttgaaggcgatcaacgatgctggtggattcaacgcgcagcgtgtggtcactctc
 I  F  L  K  A  I  N  D  A  G  G  F  N  A  Q  R  V  V  T  L cctggtctgggggaggacagcatcaagaccagcacatggttcgagccgccgagcgccaac
 P  G  L  G  E  D  S  I  K  T  S  T  W  F  E  P  P  S  A  N ttcaccaacccctgggccatccagtaccactactactctccttacgacttcatcttcagc
 F  T  N  P  W  A  I  Q  Y  H  Y  Y  S  P  Y  D  F  I  F  S gcctggggcaagaccaggtggggttctgatgcggacaaggctgctcttgaggcggacatt
 A  W  G  K  T  R  W  G  S  D  A  D  K  A  A  L  E  A  D  I gccaatatccgcaacaactttactgatgttcctctcattatcggcgagtgggccgcttcg
 A  N  I  R  N  N  F  T  D  V  P  L  I  I  G  E  W  A  A  S cctgtggccacagagtcggcagcccgctggaagtacttcgacttcatcatccggaccgcc
 P  V  A  T  E  S  A  A  R  W  K  Y  F  D  F  I  I  R  T  A aaaaagtacaatacctccactgtcctttgggacaacggcgccgacttcctcgaccgcaac
 K  K  Y  N  T  S  T  V  L  W  D  N  G  A  D  F  L  D  R  N acccatacctggcgcgatcagactgccatcgacatctacctgaacgcggtccagggcgtc
 T  H  T  W  R  D  Q  T  A  I  D  I  Y  L  N  A  V  Q  G  V gagaactcgctgcccgacagcaccgaggacggtcaggccaccagccagttcacctccgcc
 E  N  S  L  P  D  S  T  E  D  G  Q  A  T  S  Q  F  T  S  A tacatctggcaccaggttggcacccccgtgacctcgcagagcctgccttttcctcttcaac
 Y  I  W  H  Q  V  G  T  P  V  T  S  Q  S  L  P  F  L  F  N ggcaacactctctccagcgtcagtgtcggcggcaacccgctcgccgagggcagcgactac
 G  N  T  L  S  S  V  S  V  G  G  N  P  L  A  E  G  S  D  Y tcgaccaacggctccagcatcagcttctccgaatccttcctgtcacagcacctctccgcc
 S  T  N  G  S  S  I  S  F  S  E  S  F  L  S  Q  H  L  S  A gacgcagcgcctggcgtcaaggccaaccttacgctctcattctctgctggcgccgacatc
 D  A  A  P  G  V  K  A  N  L  T  L  S  F  S  A  G  A  D  I gaagtccagatcgtgcagtgggacgtcccgacgctcgccaccaacggcaccacggctgcg
 E  V  Q  I  V  Q  W  D  V  P  T  L  A  T  N  G  T  T  A  A gccgccgacaccgggtcggacctccgcatcccgatcacctggaagggcttgaacaagccg
 A  A  D  T  G  S  D  L  R  I  P  I  T  W  K  G  L  N  K  P
```

```
                    -continued
gcaacggtcaaggcgctgacaacggacggcaccatcctcgtggacgactggacgcagtac
 A  T  V  K  A  L  T  T  D  G  T  I  L  V  D  D  W  T  Q  Y ctgggcccgctcgagaaggcgcacatcacgtacaacaaccagtggaactgggacgcgtcg
 L  G  P  L  E  K  A  H  I  T  Y  N  N  Q  W  N  W  D  A  S aacatcctgctcaccagcagcgccgtcaaggctgtcgtcagcgcggccaagacgaccgtc
 N  I  L  L  T  S  S  A  V  K  A  V  V  S  A  A  K  T  T  V ttcacgatcgaattctacccgcgcgtgccgggcaacgcggtcaactacacgcttacggtt
 F  T  I  E  F  Y  P  R  V  P  G  N  A  V  N  Y  T  L  T  V tag
 -
```

SEQ ID NO: 42
LENGTH: 580
TYPE: PRT
ORGANISM: *M. phaseolina*
MRSFLYAAGLAQLGRLASALPLSAYASASAATCNGTFNAITAQQFVDRMNPGWNLGNTLDAIEDEGDWNNAPV

TEVTFDDVKKAGFKGIRLPVTWAYHFTSEAPDYTVDPAWLQRVEDVVDMITARDFYAIVNVHHDSWNWADMTA

SGANYTLIEEKFYKLWYQIGEKLACKSELVAFEPINEPPGTTAEHGAELNKLNNIFLKAINDAGGFNAQRVVT

LPGLGEDSIKTSTWFEPPSANFTNPWAIQYHYYSPYDFIFSAWGKTRWGSDADKAALEADIANIRNNFTDVPL

IIGEWAASPVATESAARWKYFDFIIRTAKKYNTSTVLWDNGADFLDRNTHTWRDQTAIDIYLNAVQGVENSLP

DSTEDGQATSQFTSAYIWHQVGTPVTSQSLPFLFNGNTLSSVSVGGNPLAEGSDYSTNGSSISFSESFLSQHL

SADAAPGVKANLTLSFSAGADIEVQIVQWDVPTLATNGTTAAAADTGSDLRIPITWKGLNKPATVKALTTDGT

ILVDDWTQYLGPLEKAHITYNNQWNWDASNILLTSSAVKAVVSAAKTTVFTIEFYPRVPGNAVNYTLTV*

SEQ ID NO: 43
LENGTH: 1476 (including 150 bp 5' UTR and 150 bp 3' UTR)
TYPE: DNA
ORGANISM: *M. phaseolina*
CCATCAATTGAGAATGAGTGGCATGAGGCGTAAGAGGGACGCTCAGGGGAGTCCTCTTATCAGTCCTCTTCCG

TGACTAAGCTAAAGTTTATTGTACACACACGTGATATTCCAACAAATTCTTTCTTCTCTACGGACTCACTT

CACGATGAAGACCGCTACTCTCGCCGCTGCGGCGTCCCTTTTCACTTCCGCCGCCCTCGCCGCACCCACCAGC

ACCTTGAAGGCTGCTGCCGCCTCCAAGGTCAAGTTCGCCGGCGTCAACATTGCCGGCTTCGACTTCGGCTGCG

GCACAGATGGAACCTGCACACAGACCGCATCAACCGCCACCGACCCCTTGACCGACTCCGACGGCCAGGGTCA

AATGGACCACTTTGTCAAGGACGACAAGCTCAACGCATTCCGCCTGCCCGTCGGCTGGCAGTACCTGGTCGCC

AACAAGCTCGGCGGCGACCTAGACTCGGCCAACGCCGGTAAATACGACAATCTTGTCCAGGGGTGTCTCAAGT

CCGGGGCCGAGCTCTGTATCATCGACATCCATAACTACGCCCGCTGGAACGGCCAGATCATCGGCCAGGGTGG

CCCCACCAACGACCAGTTCGTCTCGCTCTGGAAGCAGCTGGCTACAAAGTACAAGGACAACACCAAGGTGGCG

TTCGGGGTCATGAATGAGCCCCACGACGTGCCCGACATCAACAAGTGGGCCGACACGGTCCAGCAGGTCGTCA

CCGCCATCCGCAATGCTGGCGCAACGACGCAATACGTGCTCCTGCCGGGCAATGACTGGACGAGCGCCGCGGC

CTTCATTGATAATGGCTCTGCGGCGGCGTTGAAGAAGGTGACCAACCCCGACGGCTCGACCGACAACCTGATC

TTCGACGTGCACAAGTACCTCGACAGCGATAACTCGGGCACGCATACTGAGTGCGTGACAAACAACATCGACG

ATGCGTTCAAGCCGCTTGCCGACTGGTTGAGGCAGAACAAGCGCATGGCGATCAACACGGAGAGCGGTGGCGG

CAACACCGACTCTTGCGAGAAATACTTCTGCGAGCAGATTCAGTACTTGAAGTGAGTCTTCCCCCTTATTTAT

TTGCTTTTGTCCtTTTTTTTTGGCTTTTTAGAATGATTGGAAGCTCAtTCtTTTTTTTTTTTTTGtCAGCC

AAAATGCCGATGTCTTCCTCGGTTACACTGCGTGGTCGGCTGGTGGGTTCGATCAGACATATGAGCTTGTCCA

GACGCCGATTAAGCAGTCCGATGGCACGTACAAAGATACTGCACTCGCGCAGAAGTGCACTGTTGGTGCTTGG

GCGAATGCTTGAGGGCCGTCACGAATTCATGTATTGAGGTGATTCATACGAAAGCATGAGCCTGTTGACAGCT

GCGACTGTCACCTGGGATGATTGCAATCATTTAGCACATCATTGAGTAGTCTCCGAAGAATACAAACAATCTG

AAGCGTCAATTCCAGC

-continued

SEQ ID NO: 44
LENGTH: 1083
TYPE: DNA
ORGANISM: M. phaseolina
FEATURE NAME/KEY: CDS
LOCATION: (1)...(1083)

```
atgaagaccgctactctcgccgctgcggcgtcccttttcacttccgccgccctcgccgca
 M   K   T   A   T   L   A   A   A   A   S   L   F   T   S   A   A   L   A   A cccaccagcaccttgaaggctgctgccgcctccaaggtcaagttcgccggcgtcaacatt
 P   T   S   T   L   K   A   A   A   A   S   K   V   K   F   A   G   V   N   I gccggcttcgacttcggctgcggcacagatggaacctgcacacagaccgcatcaaccgcc
 A   G   F   D   F   G   C   G   T   D   G   T   C   T   Q   T   A   S   T   A accgacccttgaccgactccgacggccagggtcaaatggaccactttgtcaaggacgac
 T   D   P   L   T   D   S   D   G   Q   G   Q   M   D   H   F   V   K   D   D aagctcaacgcattccgcctgcccgtcggctggcagtacctggtcgccaacaagctcggc
 K   L   N   A   F   R   L   P   V   G   W   Q   Y   L   V   A   N   K   L   G ggcgacctagactcggccaacgccggtaaatacgacaatcttgtccaggggtgtctcaag
 G   D   L   D   S   A   N   A   G   K   Y   D   N   L   V   Q   G   C   L   K tccggggccgagctctgtatcatcgacatccataactacgcccgctggaacggccagatc
 S   G   A   E   L   C   I   I   D   I   H   N   Y   A   R   W   N   G   Q   I atcggccagggtggcccccaccaacgaccagttcgtctcgctctggaagcagctggctaca
 I   G   Q   G   G   P   T   N   D   Q   F   V   S   L   W   K   Q   L   A   T aagtacaaggacaacaccaaggtggcgttcggggtcatgaatgagccccacgacgtgccc
 K   Y   K   D   N   T   K   V   A   F   G   V   M   N   E   P   H   D   V   P gacatcaacaagtgggccgacacggtccagcaggtcgtcaccgccatccgcaatgctggc
 D   I   N   K   W   A   D   T   V   Q   Q   V   V   T   A   I   R   N   A   G gcaacgacgcaatacgtgctcctgccgggcaatgactggacgagcgccgcggccttcatt
 A   T   T   Q   Y   V   L   L   P   G   N   D   W   T   S   A   A   A   F   I gataatggctctgcggcggcgttgaagaaggtgaccaaccccgacggctcgaccgacaac
 D   N   G   S   A   A   A   L   K   K   V   T   N   P   D   G   S   T   D   N ctgatcttcgacgtgcacaagtacctcgacagcgataactcgggcacgcatactgagtgc
 L   I   F   D   V   H   K   Y   L   D   S   D   N   S   G   T   H   T   E   C gtgacaaacaacatcgacgatgcgttcaagccgcttgccgactggttgaggcagaacaag
 V   T   N   N   I   D   D   A   F   K   P   L   A   D   W   L   R   Q   N   K cgcatggcgatcaacacggagagcggtggcggcaacaccgactcttgcgagaaatacttc
 R   M   A   I   N   T   E   S   G   G   G   N   T   D   S   C   E   K   Y   F tgcgagcagattcagtacttgaaccaaaatgccgatgtcttcctcggttacactgcgtgg
 C   E   Q   I   Q   Y   L   N   Q   N   A   D   V   F   L   G   Y   T   A   W tcggctggtgggttcgatcagacatatgagcttgtccagacgccgattaagcagtccgat
 S   A   G   G   F   D   Q   T   Y   E   L   V   Q   T   P   I   K   Q   S   D ggcacgtacaaagatactgcactcgcgcagaagtgcactgttggtgcttgggcgaatgct
 G   T   Y   K   D   T   A   L   A   Q   K   C   T   V   G   A   W   A   N   A tga
 -
```

SEQ ID NO: 45
LENGTH: 360
TYPE: PRT
ORGANISM: M. phaseolina

MKTATLAAAASLFTSAALAAPTSTLKAAAASKVKFAGVNIAGFDFGCGTDGTCTQTASTATDPLTDSDGQGQM

DHFVKDDKLNAFRLPVGWQYLVANKLGGDLDSANAGKYDNLVQGCLKSGAELCIIDIHNYARWNGQIIGQGGP

TNDQFVSLWKQLATKYKDNTKVAFGVMNEPHDVPDINKWADTVQQVVTAIRNAGATTQYVLLPGNDWTSAAAF

IDNGSAAALKKVTNPDGSTDNLIFDVHKYLDSDNSGTHTECVTNNIDDAFKPLADWLRQNKRMAINTESGGGN

TDSCEKYFCEQIQYLNQNADVFLGYTAWSAGGFDQTYELVQTPIKQSDGTYKDTALAQKCTVGAWANA*

-continued

SEQ ID NO: 46
LENGTH: 1781 (including 150 bp 5' UTR and 150 bp 3' UTR)
TYPE: DNA
ORGANISM: M. phaseolina

CGGTAGGAAGCATCCCCTTCTTCGTCGACGTAGTTGTCCTCTCTTCGGAGTATTGTATACTCTTTTCGGTCAT

TCCTTAGCCTGGTTGCTTCAGCACGTTCTTTAAACCCGCCGAACACAGCAAACATTTTTTGATTCGCCACATT

CGCTATGCCATCCTTCAAATCTTCCTCCATGCAGGCCATGCTGGCTCTGGCCGCATCGGCCACCGCTCTTCCC

ACCTTTTCCTCAATGCAGAAGCGCCAAGCCTCTCAATCTCCTGCCAACCTGTGCGGCATGCCCGATGATTCGC

TTATCCTTTCGGGAACGCCCTGGATTGTCTACAATATGATGTACAACTCTGCCCAGATCGAGGGCACTGCTTG

CACAGGATACGTCGGCACTACCACCGATGCCAATGGCAACCAGGCCGTCAAGTGGAACAGTACCTGGAACATC

GAATACGTTCAGTCCACCGATAACGTTCCCAAGGGCTACTCTTTCGTCGGTCTGACCCAGAACCTGGAAAGCC

GTATCAGCGACATTGGCTCTATTCCCACCACCTACGAGTGGACTAGGACCAACACGACAGCTTACAAGGGCAA

CGTCTGCTACGACTTCATGACCTCGGATACCAAGGGCGACTCCACCAGCTCCAATGCCCAGGAGCTGATGCTC

TGGCTGCAGTATGATGGTGGTCAGTTGCCCATTGGCTGGACCGCCGGTGCTGTTGCTACCATTGACAACCTCT

ACGGTACCTCCTGGAAGCTTTACCAGGGCAAGAACGACGACACCGGCATTACTGTCAGCAGCCTGCTGCCCGA

CACCCAGTTCGATGGCTCTTTCAGTGGTGACATTAAGGACTGGCTCGAAGCTCTCGTTAAGCAGGGCCTCTTC

ACTGAGAGTACATATGTGAATGTCGGCAACGCAGGAAGTAGATACCCCTTCGTGATCCTAATACTTCTTCCCT

TACTGATTGCAAAACTCTAGCCGAGCCCTTCTACGGTGACTGCGTTCTTGACGCCACCCTCGCTCTCCAGGTC

AACCTTGGATCCGACACCACCGCCGAGTCTGTGACCCCCATTTCTTCTGTGGTCCCTACCTCCACTGCTGCCC

CATCATCTACCGAGGTTCCCGCATCCACTAAAGTGCCCGCTTCCGCCGAAACCCCTCCACCATCATCATCATC

ATCATCTACCCCCGCCGCGACGCCTTCCTCCAGCGCTGCGACTTTCGTCCTCCCCTCCTCCAGCAGCACCATC

ACCGTCGAGTCCACCGAGCTCCCCACCAGCACTCCTCCCACAACGCTGGCCAGCACGCTCGCCGCCCCTCCT

CCGCTGCCAACGGTGCCGACTCAATCCCCTCCTCCTCCATCGAGGCGCCCGCCTCCAATACAACCCTTCCGGC

CACCCCGTCATCTCCCGCCCCAACTCCTGCGATAAGCACTCCAGCCACCCCCACCCCCAGCGCTGCTGACCCC

GTATCCCCTACAGGTAACTACGGTCCTCCTTCTAGCTTCAGCGGCTTCGGCAACGATGGCCCCGCACCTACTC

CTGGATCCGGTGTTTCTGGTGACCAGGGCCAGAGTCCCGCTCCTGGGGAGGGTGAAGACGACGAGGGCCCTTG

TGCGGTCGAGTACATTTACGTATAAGCGCCTCCATGGATGAGAAAAATGAGATGGGGAGGGTTGGGCCTTGAC

GGGGACGTATAGAGCGATGGaAACAAAAAAAAAAAAAAAGAGCGGTGAATTGAAATGGGGGACAGGTGTGGGT

GTGTCTGCCAGTTCCTCATTCGGTCCTTT

SEQ ID NO: 47
LENGTH: 1395
TYPE: DNA
ORGANISM: M. phaseolina
FEATURE NAME/KEY: CDS
LOCATION: (1)...(1395)
atgccatccttcaaatcttcctccatgcaggccatgctggctctggccgcatcggccacc
 M  P  S  F  K  S  S  S  M  Q  A  M  L  A  L  A  A  S  A  T gctcttcccaccttttcctcaatgcagaagcgccaagcctctcaatctcctgccaacctg
 A  L  P  T  F  S  S  M  Q  K  R  Q  A  S  Q  S  P  A  N  L tgcggcatgcccgatgattcgcttatcctttcgggaacgccctggattgtctacaatatg
 C  G  M  P  D  D  S  L  I  L  S  G  T  P  W  I  V  Y  N  M atgtacaactctgcccagatcgagggcactgcttgcacaggatacgtcggcactaccacc
 M  Y  N  S  A  Q  I  E  G  T  A  C  T  G  Y  V  G  T  T  T gatgccaatggcaaccaggccgtcaagtggaacagtacctggaacatcgaatacgttcag
 D  A  N  G  N  Q  A  V  K  W  N  S  T  W  N  I  E  Y  V  Q tccaccgataacgttcccaagggctactctttcgtcggtctgacccagaacctggaaagc
 S  T  D  N  V  P  K  G  Y  S  F  V  G  L  T  Q  N  L  E  S cgtatcagcgacattggctctattcccaccacctacgagtggactaggaccaacacgaca
 R  I  S  D  I  G  S  I  P  T  T  Y  E  W  T  R  T  N  T  T

```
gcttacaagggcaacgtctgctacgacttcatgacctcggataccaagggcgactccacc
 A  Y  K  G  N  V  C  Y  D  F  M  T  S  D  T  K  G  D  S  T agctccaatgcccaggagctgatgctctggctgcagtatgatggtggtcagttgcccatt
 S  S  N  A  Q  E  L  M  L  W  L  Q  Y  D  G  G  Q  L  P  I ggctggaccgccggtgctgttgctaccattgacaacctctacggtacctcctggaagctt
 G  W  T  A  G  A  V  A  T  I  D  N  L  Y  G  T  S  W  K  L taccagggcaagaacgacgacaccggcattactgtcagcagcctgctgcccgacacccag
 Y  Q  G  K  N  D  D  T  G  I  T  V  S  S  L  L  P  D  T  Q ttcgatggctctttcagtggtgacattaaggactggctcgaagctctcgttaagcagggc
 F  D  G  S  F  S  G  D  I  K  D  W  L  E  A  L  V  K  Q  G ctcttcactgagaccgagcccttctacggtgactgcgttcttgacgccaccctcgctctc
 L  F  T  E  T  E  P  F  Y  G  D  C  V  L  D  A  T  L  A  L caggtcaaccttggatccgacaccaccgccgagtctgtgaccccatttcttctgtggtc
 Q  V  N  L  G  S  D  T  T  A  E  S  V  T  P  I  S  S  V  V cctacctccactgctgccccatcatctaccgaggttcccgcatccactaaagtgcccgct
 P  T  S  T  A  A  P  S  S  T  E  V  P  A  S  T  K  V  P  A tccgccgaaacccctccaccatcatcatcatcatctaccccgccgcgacgccttcc
 S  A  E  T  P  P  P  S  S  S  S  S  T  P  A  A  T  P  S tccagcgctgcgactttcgtcctcccctcctccagcagcaccatcaccgtcgagtccacc
 S  S  A  A  T  F  V  L  P  S  S  S  S  T  I  T  V  E  S  T gagctcccaccagcactcctcccacaacgctggccagcacgctcgccgcccctcctcc
 E  L  P  T  S  T  P  P  T  T  L  A  S  T  L  A  A  P  S  S gctgccaacggtgccgactcaatcccctcctcctccatcgaggcgcccgcctccaataca
 A  A  N  G  A  D  S  I  P  S  S  S  I  E  A  P  A  S  N  T acccttccggccacccgtcatctcccgcccaactcctgcgataagcactccagccacc
 T  L  P  A  T  P  S  S  P  A  P  T  P  A  I  S  T  P  A  T cccaccccagcgctgctgaccccgtatcccctacaggtaactacggtcctccttctagc
 P  T  P  S  A  A  D  P  V  S  P  T  G  N  Y  G  P  P  S  S ttcagcggcttcggcaacgatggccccgcacctactcctggatccggtgtttctggtgac
 F  S  G  F  G  N  D  G  P  A  P  T  P  G  S  G  V  S  G  D cagggccagagtcccgctcctggggagggtgaagacgacgagggcccttgtgcggtcgag
 Q  G  Q  S  P  A  P  G  E  G  E  D  D  E  G  P  C  A  V  E tacatttacgtataa
 Y  I  Y  V  -

SEQ ID NO: 48
LENGTH: 464
TYPE: PRT
ORGANISM: M. phaseolina
MPSFKSSSMQAMLALAASATALPTFSSMQKRQASQSPANLCGMPDDSLILSGTPWIVYNMMYNSAQIEGTACT

GYVGTTTDANGNQAVKWNSTWNIEYVQSTDNVPKGYSFVGLTQNLESRISDIGSIPTTYEWTRTNTTAYKGNV

CYDFMTSDTKGDSTSSNAQELMLWLQYDGGQLPIGWTAGAVATIDNLYGTSWKLYQGKNDDTGITVSSLLPDT

QFDGSFSGDIKDWLEALVKQGLFTETEPFYGDCVLDATLALQVNLGSDTTAESVTPISSVVPTSTAAPSSTEV

PASTKVPASAETPPPSSSSSSTPAATPSSSAATFVLPSSSSTITVESTELPTSTPPTTLASTLAAPSSAANGA

DSIPSSSIEAPASNTTLPATPSSPAPTPAISTPATPTPSAADPVSPTGNYGPPSSFSGFGNDGPAPTPGSGVS

GDQGQSPAPGEGEDDEGPCAVEYIYV*

SEQ ID NO: 49
LENGTH: 1842 (including 150 bp 5' UTR and 150 bp 3' UTR)
TYPE: DNA
ORGANISM: M. phaseolina
ATCCCGTCCTCCAGCGCCTGCTGCGAGTAATGGCCCCTTTCGAGAACACTTCCACCAGGAACCAGCAGCTCCA

GCGCGTATAAAACCACGGATGGCGACATCCAAGTCGGCCCTCATCCAGCAACCGCCTTCTCTCCGCCATCTTG

CACCATGCTTTCCCACGCGCTGCTCGCTGCTCTCTCCGCCTCGCTGGTCGCCGGCCAGCAGGTGGGCACCCAG

AAGGCCGAGGTTTGTTTCCTGCGCCCTGGCCCAGCCGGTGCACAGCGGCCGCTGACACAGGCACGCAGGTCCA
```

-continued

CCCCCCCTTGACCTGGCAGAGCTGCACCAAGAGCGGCTGCACCACCAACCAGGGTTCCGTGGTCATCGACGCC

AACTGGCGCTGGGTCCACAACACCGGCGGCTACACCAACTGCTACACCGGTATGTTTGCGCCCTTCCATGCAC

CCGCCAGCTCGTGACAGGTCCCAGGCAACTCGTGGAACTCGGCCTACTGCACTGACAACGCCGCCTGCGCCGC

CGCCTGCGCTCTCGATGGCGCTGACTACTCGGGCACCTACGGCGCCACCACCAGCGGCAACTCCCTGCGCCTG

AACTTCATCACCAACGGCGCGCAGAAGAACGTCGGCTCGCGTATGTACCTGATGAAGGACGACAACACCTACG

CCGTCCACAAGCTCCTCAACCAGGAGTTCACCTTCGACGTCGACGTCTCCAAGCTGCCCTGCGGCCTCAACGG

CGCCGTCTACTTCGTCTCCATGGACGCTGACGGCGGCAAGGCCAAGTTCCCGGCCAACAAGGCCGGCGCCAAG

TACGGCACTGGCTACTGCGACAGCCAGTGCCCGCGTGACTTGAAGTTCATCGACGGCCAGGCCAACGTCAAGG

GCTGGACCCCGTCCGACTCTGACGTCAACTCTGGCGTCGGCAATCTCGGATCCTGCTGTGCCGGTACGTCGCT

GCCATCTCTCTCCTTTCTGCATGTCATGCGCCGAACGGATGCTAACCGCGCGTTCAGAGATGGATATCTGGGA

GGCCAACTCCATCTCCACCGCCTACACCCCCCACCCGTGCACCAACTCCGCCCAGCACTCTTGCCAGGGCGAT

GCGTGCGGTGGCACCTACTCGGCCGACCGCTACGCCGGCGACTGCGACCCCGACGGATGCGACTTCAACTCAT

TCCGCCAAGGCAACAAGACCTTCTACGGGCCCGGCCTCACCGTCGACACCAACTCCAAGATCACCGTGGTCAC

GCAGTTCATCACCAACACCGGCACCGCCTCGGGCACGCTCAAGGAGATCAAGCGCTTCTACGTGCAGAACGGC

AAGACGATCCCCAACTCGGTGTCGACCATCTCCGGCGTGCCCGGCAACTCGGTCACCGACTCCTTCTGCACCG

CCCAGAAGTCCGTCTTCGGCGACAACAACATTTTCCAGAAGAGGGGTGGCCTGGCCGGCATGTCCCAGGCCCT

CAACGCCGGCATGGTCCTCGTGCTCTCCATCTGGGATGACCACCACAGCAACATGCTCTGGCTCGACAGCGAC

TTCCCCACCGACGCCGACCCGGCCAAGCCCGGTATTTCCCGTGGAACCTGCCCCACCACCAGCGGTGACCCCG

ATGACGTCGAGTCGTCCGCCGCCAACGCCTACGTCGTCTACTCCAACATCAAAGTTGGTGCCATCAACAGCAC

CTTCACTCCTTAGGCGACAGGAAAGAGCATGGAAAGTCGTAGTTTGTATTGAGCGGGATGCGAGGAGGTACGC

GGCCGGGGTTAGGAGTGTGAAATAAGAGCTGGGAGCACTCGGCTTCGAAGCAACATGCTTCAACGTCTCTGGA

TTCCTGCCGCGTGCTGG

SEQ ID NO: 50
LENGTH: 1368
TYPE: DNA
ORGANISM: *M. phaseolina*
FEATURE NAME/KEY: CDS
LOCATION: (1)...(1368)

```
atgctttcccacgcgctgctcgctgctctctccgcctcgctggtcgccggccagcaggtg
 M  L  S  H  A  L  L  A  A  L  S  A  S  L  V  A  G  Q  Q  V ggcacccagaaggccgaggtccacccccccttgacctggcagagctgcaccaagagcggc
 G  T  Q  K  A  E  V  H  P  P  L  T  W  Q  S  C  T  K  S  G tgcaccaccaaccagggttccgtggtcatcgacgccaactggcgctgggtccacaacacc
 C  T  T  N  Q  G  S  V  V  I  D  A  N  W  R  W  V  H  N  T ggcggctacaccaactgctacaccggcaactcgtggaactcggcctactgcactgacaac
 G  G  Y  T  N  C  Y  T  G  N  S  W  N  S  A  Y  C  T  D  N gccgcctgcgccgccgcctgcgctctcgatggcgctgactactcgggcacctacggcgcc
 A  A  C  A  A  A  C  A  L  D  G  A  D  Y  S  G  T  Y  G  A accaccagcggcaactccctgcgcctgaacttcatcaccaacggcgcgcagaagaacgtc
 T  T  S  G  N  S  L  R  L  N  F  I  T  N  G  A  Q  K  N  V ggctcgcgtatgtacctgatgaaggacgacaacacctacgccgtccacaagctcctcaac
 G  S  R  M  Y  L  M  K  D  D  N  T  Y  A  V  H  K  L  L  N caggagttcaccttcgacgtcgacgtctccaagctgccctgcggcctcaacggcgccgtc
 Q  E  F  T  F  D  V  D  V  S  K  L  P  C  G  L  N  G  A  V tacttcgtctccatggacgctgacggcggcaaggccaagttcccggccaacaaggccggc
 Y  F  V  S  M  D  A  D  G  G  K  A  K  F  P  A  N  K  A  G gccaagtacggcactggctactgcgacagccagtgcccgcgtgacttgaagttcatcgac
 A  K  Y  G  T  G  Y  C  D  S  Q  C  P  R  D  L  K  F  I  D
```

```
ggccaggccaacgtcaagggctggaccccgtccgactctgacgtcaactctggcgtcggc
 G  Q  A  N  V  K  G  W  T  P  S  D  S  D  V  N  S  G  V  G aatctcggatcctgctgtgccgagatggatatctgggaggccaactccatctccaccgcc
 N  L  G  S  C  C  A  E  M  D  I  W  E  A  N  S  I  S  T  A tacaccccacccgtgcaccaactccgcccagcactcttgccagggcgatgcgtgcggt
 Y  T  P  H  P  C  T  N  S  A  Q  H  S  C  Q  G  D  A  C  G ggcacctactcggccgaccgctacgccggcgactgcgaccccgacggatgcgacttcaac
 G  T  Y  S  A  D  R  Y  A  G  D  C  D  P  D  G  C  D  F  N tcattccgccaaggcaacaagaccttctacgggcccggcctcaccgtcgacaccaactcc
 S  F  R  Q  G  N  K  T  F  Y  G  P  G  L  T  V  D  T  N  S aagatcaccgtggtcacgcagttcatcaccaacaccggcaccgcctcgggcacgctcaag
 K  I  T  V  V  T  Q  F  I  T  N  T  G  T  A  S  G  T  L  K gagatcaagcgcttctacgtgcagaacggcaagacgatccccaactcggtgtcgaccatc
 E  I  K  R  F  Y  V  Q  N  G  K  T  I  P  N  S  V  S  T  I tccggcgtgcccggcaactcggtcaccgactccttctgcaccgcccagaagtccgtcttc
 S  G  V  P  G  N  S  V  T  D  S  F  C  T  A  Q  K  S  V  F ggcgacaacaacatttccagaagaggggtggcctggccggcatgtcccaggccctcaac
 G  D  N  N  I  F  Q  K  R  G  G  L  A  G  M  S  Q  A  L  N gccggcatggtcctcgtgctctccatctgggatgaccaccacagcaacatgctctggctc
 A  G  M  V  L  V  L  S  I  W  D  D  H  H  S  N  M  L  W  L gacagcgacttccccaccgacgccgacccggccaagcccggtatttcccgtggaacctgc
 D  S  D  F  P  T  D  A  D  P  A  K  P  G  I  S  R  G  T  C cccaccaccagcggtgaccccgatgacgtcgagtcgtccgccgccaacgcctacgtcgtc
 P  T  T  S  G  D  P  D  D  V  E  S  S  A  A  N  A  Y  V  V tactccaacatcaaagttggtgccatcaacagcaccttcactccttag
 Y  S  N  I  K  V  G  A  I  N  S  T  F  T  P  -

SEQ ID NO: 51
LENGTH: 455
TYPE: PRT
ORGANISM: M. phaseolina
MLSHALLAALSASLVAGQQVGTQKAEVHPPLTWQSCTKSGCTTNQGSVVIDANWRWVHNTGGYTNCYTGNSWN

SAYCTDNAACAAACALDGADYSGTYGATTSGNSLRLNFITNGAQKNVGSRMYLMKDDNTYAVHKLLNQEFTFD

VDVSKLPCGLNGAVYFVSMDADGGKAKFPANKAGAKYGTGYCDSQCPRDLKFIDGQANVKGWTPSDSDVNSGV

GNLGSCCAEMDIWEANSISTAYTPHPCTNSAQHSCQGDACGGTYSADRYAGDCDPDGCDFNSFRQGNKTFYGP

GLTVDTNSKITVVTQFITNTGTASGTLKEIKRFYVQNGKTIPNSVSTISGVPGNSVTDSFCTAQKSVFGDNNI

FQKRGGLAGMSQALNAGMVLVLSIWDDHHSNMLWLDSDEPTDADPAKPGISRGTCPTTSGDPDDVESSAANAY

VVYSNIKVGAINSTFTP*

SEQ ID NO: 52
LENGTH: 1967 (including 150 bp 5' UTR and 150 bp 3' UTR)
TYPE: DNA
ORGANISM: M. phaseolina
GAAACATATTCGTTTCAATCTAATGTACTCAAGGGAGGAATAACGGGGACAGCGGCTTGTCGACAACCGGCTC

AAGACTATAAGAGCCCAGTGAGACCCTGCTAAGTTTTGCTCTCCAGTTGCCGGACAACATCCTCTCACTAGCC

CATCATGTACCAGACTTCCATTCTTTCTTTCTTTCCCTGCTTCTTGCGGCCTCCAGCGCCCAGCAGGTCGGC

ACGCAGACCGCCGAGACGCACCCCAAGCTCACCACGCAAAAGTGCACCAAGGCCGGCGGCTGCACCGACCAGG

CCACCTCCATCGTTCTTGACGCCAACTGGCGCTGGCTCCATACGACTGAGGGCTACACCAACTGCTACACCGG

CCAGGAGTGGGACACTTCCATTTGTTCCGACCCCAAGACTTGCGCCACTAGCTGCGCTCTCGATGGCGCCGAT

TATGAGGGAACGTACGGTATCACGACCAGCGGCAACGCTCTTACGATGAAGTTCGTCACGCAGGGGTCTCAGA

AGAACGTCGGTGGCCGTGTCTACCTATTGGCCCCTGACAGCGACGACACGTACGAGCTCTTCAAGCTCAAGAA

CCAGGAGTTCACTTTTGACGTTGACGTCTCGAACCTCCCTTGCGGTCTCAATGGCGCTCTCTACTTCTCTGAG

GTTCGTAATCTTATCGTCAATGCGCTGCTTGCGTTACTGACGCTCTCAGATGGACGCCGATGGTGGCCTGTCC
```

```
AAGTACGAGACCAACAAGGCCGGTGCCAAGTATGGTACTGGTTACTGCGACACCCAGTGCCCGCACGACATTA

AGTTCATCAACGGCGAGGCCAACGTCCTTAACTGGACCAAGTCCGAGACGGATGTCAACGCCGGTTCCGGTCA

ATACGGTTCTTGCTGGTAAGTGGCCTTCACATCAGGGCAACGCCCCTTTTTGCACCAACGGAACATAGAATTC

CGAAACGCCCTTGGAAAGCTCTCGTCTATGGGTATTCGCTAATGCTGAAAACAGCTTTGAGTTTGATGTCTGG

GAGGCGAACTCTCAAGCAACTGCTTTGACCCCCCACGTTTGCACTGCTGCCGTAAGTGTTCACTTCGTGTCCA

ATAGTTGCCACGAACCATTACTGATCGTGAAAAGACCGTTGGCCAGGTCCGCTGTGAGGGCGATGACTGTGGA

GATGGTGACAACCGCTACGGCGGCATCTGTGACAAGGACGGCTGTGACTTCAACCCGTACCGCATGGGCAATG

AGACTTTCTACGGCACCAACAACAGCGTCATCGACACCACCAAGAAGTTCACCATCGTGACGCAGTTCAGTGG

GTTTCCCGACCCACGGATACCGCCTTAAGCTCCGCAAGCTGATGAACTATACAGTTACTTCTGACAACACCGC

CGACGGTGAGCTCGTTGAGATCCGCCGCAAGTACGTCCAGGATGGCAAGGTCATCGAGAACTCGTTCGCCGAC

TACGACACCCTCTCCCAGTTTAACTCCATCTCGGACGACTTCTGTGACGCTCAGAAGACTCTCTTTGGCGACA

ACAATGACTTCAAGACCAAGGGTGGTCTCTCTGTCATGGGTGAATCCCTCGCTCGCGGTCAGGTCCTTGTTAT

GTCCATCTGGGACGACCATGCTGCGAACGCCCTCTGGCTCGACTCTAGCTACCCCACCGACGCCGATCCGAGC

AAGCCTGGTGTCAAGCGTGGTCCTTGTGGCACTGATACTGGCAAGCCCGACGATGTTGAGGCCCAGTACCCCG

ACAGCACTGTTGTCTACAGCAACATCCGCTACGGTGACATCGACTCCACCTACACTTCCGCTTAAAGGGGAAA

TTTCTGTACGCGGATGGGCAAATATGAGGACAACCGCCGGGTAACTCAAACCAAAAGTTCCCTCTACCTTTA

CTGTTTCGTAAGATGGATCTCTCAAGGCTCCCTTCCGCAATCCTCTCTCTACCTTCTATCATTCTAGAG
```

SEQ ID NO: 53
LENGTH: 1392
TYPE: DNA
ORGANISM: M. phaseolina
FEATURE NAME/KEY: CDS
LOCATION: (1)...(1392)

```
atgtaccagacttccattctttcttctctttccctgcttcttgcggcctccagcgcccag
 M  Y  Q  T  S  I  L  S  S  L  S  L  L  L  A  A  S  S  A  Q caggtcggcacgcagaccgccgagacgcaccccaagctcaccacgcaaaagtgcaccaag
 Q  V  G  T  Q  T  A  E  T  H  P  K  L  T  T  Q  K  C  T  K gccggcggctgcaccgaccaggccacctccatcgttcttgacgccaactggcgctggctc
 A  G  G  C  T  D  Q  A  T  S  I  V  L  D  A  N  W  R  W  L catacgactgagggctacaccaactgctacaccggccaggagtgggacacttccatttgt
 H  T  T  E  G  Y  T  N  C  Y  T  G  Q  E  W  D  T  S  I  C tccgaccccaagacttgcgccactagctgcgctctcgatggcgccgattatgagggaacg
 S  D  P  K  T  C  A  T  S  C  A  L  D  G  A  D  Y  E  G  T tacggtatcacgaccagcggcaacgctcttacgatgaagttcgtcacgcaggggtctcag
 Y  G  I  T  T  S  G  N  A  L  T  M  K  F  V  T  Q  G  S  Q aagaacgtcggtggccgtgtctacctattggcccctgacagcgacgacacgtacgagctc
 K  N  V  G  G  R  V  Y  L  L  A  P  D  S  D  D  T  Y  E  L ttcaagctcaagaaccaggagttcacttttgacgttgacgtctcgaacctcccttgcggt
 F  K  L  K  N  Q  E  F  T  F  D  V  D  V  S  N  L  P  C  G ctcaatggcgctctctacttctctgagatggacgccgatggtggcctgtccaagtacgag
 L  N  G  A  L  Y  F  S  E  M  D  A  D  G  G  L  S  K  Y  E accaacaaggccggtgccaagtatggtactggttactgcgacacccagtgcccgcacgac
 T  N  K  A  G  A  K  Y  G  T  G  Y  C  D  T  Q  C  P  H  D attaagttcatcaacggcgaggccaacgtccttaactggaccaagtccgagacggatgtc
 I  K  F  I  N  G  E  A  N  V  L  N  W  T  K  S  E  T  D  V aacgccggttccggtcaatacggttcttgctgctttgagtttgatgtctgggaggcgaac
 N  A  G  S  G  Q  Y  G  S  C  C  F  E  F  D  V  W  E  A  N tctcaagcaactgctttgacccccccacgtttgcactgctgccaccgttggccaggtccgc
 S  Q  A  T  A  L  T  P  H  V  C  T  A  A  T  V  G  Q  V  R tgtgagggcgatgactgtggagatggtgacaaccgctacggcggcatctgtgacaaggac
 C  E  G  D  D  C  G  D  G  D  N  R  Y  G  G  I  C  D  K  D
```

-continued

```
ggctgtgacttcaacccgtaccgcatgggcaatgagactttctacggcaccaacaacagc
 G   C   D   F   N   P   Y   R   M   G   N   E   T   F   Y   G   T   N   N   S gtcatcgacaccaccaagaagttcaccatcgtgacgcagttcattacttctgacaacacc
 V   I   D   T   T   K   K   F   T   I   V   T   Q   F   I   T   S   D   N   T gccgacggtgagctcgttgagatccgccgcaagtacgtccaggatggcaaggtcatcgag
 A   D   G   E   L   V   E   I   R   R   K   Y   V   Q   D   G   K   V   I   E aactcgttcgccgactacgacaccctctcccagtttaactccatctcggacgacttctgt
 N   S   F   A   D   Y   D   T   L   S   Q   F   N   S   I   S   D   D   F   C gacgctcagaagactctctttggcgacaacaatgacttcaagaccaagggtggtctctct
 D   A   Q   K   T   L   F   G   D   N   N   D   F   K   T   K   G   G   L   S gtcatgggtgaatccctcgctcgcggtcaggtccttgttatgtccatctgggacgaccat
 V   M   G   E   S   L   A   R   G   Q   V   L   V   M   S   I   W   D   D   H gctgcgaacgccctctggctcgactctagctaccccaccgacgccgatccgagcaagcct
 A   A   N   A   L   W   L   D   S   S   Y   P   T   D   A   D   P   S   K   P ggtgtcaagcgtggtccttgtggcactgatactggcaagcccgacgatgttgaggcccag
 G   V   K   R   G   P   C   G   T   D   T   G   K   P   D   D   V   E   A   Q taccccgacagcactgttgtctacagcaacatccgctacggtgacatcgactccacctac
 Y   P   D   S   T   V   V   Y   S   N   I   R   Y   G   D   I   D   S   T   Y acttccgcttaa
 T   S   A   -
```

SEQ ID NO: 54
LENGTH: 463
TYPE: PRT
ORGANISM: M. phaseolina
MYQTSILSSLSLLLAASSAQQVGTQTAETHPKLTTQKCTKAGGCTDQATSIVLDANWRWLHTTEGYTNCYTGQ

EWDTSICSDPKTCATSCALDGADYEGTYGITTSGNALTMKFVTQGSQKNVGGRVYLLAPDSDDTYELFKLKNQ

EFTFDVDVSNLPCGLNGALYFSEMDADGGLSKYETNKAGAKYGTGYCDTQCPHDIKFINGEANVLNWTKSETD

VNAGSGQYGSCCFEFDVWEANSQATALTPHVCTAATVGQVRCEGDDCGDGDNRYGGICDKDGCDFNPYRMGNE

TFYGTNNSVIDTTKKFTIVTQFITSDNTADGELVEIRRKYVQDGKVIENSFADYDTLSQFNSISDDFCDAQKT

LFGDNNDFKTKGGLSVMGESLARGQVLVMSIWDDHAANALWLDSSYPTDADPSKPGVKRGPCGTDTGKPDDVE

AQYPDSTVVYSNIRYGDIDSTYTSA*

SEQ ID NO: 55
LENGTH: 886 (including 150 bp 5' UTR and 150 bp 3' UTR)
TYPE: DNA
ORGANISM: M. phaseolina
TCACTTCGTGTCCAATAGTTGCCACGAACCATTACTGATCGTGAAAAGACCGTTGGCCAGGTCCGCTGTGAGG

GCGATGACTGTGGAGATGGTGACAACCGCTACGGCGGCATCTGTGACAAGGACGGCTGTGACTTCAACCCGTA

CCGCATGGGCAATGAGACTTTCTACGGCACCAACAACAGCGTCATCGACACCACCAAGAAGTTCACCATCGTG

ACGCAGTTCAGTGGGTTTCCCGACCCACGGATACCGCCTTAAGCTCCGCAAGCTGATGAACTATACAGTTACT

TCTGACAACACCGCCGACGGTGAGCTCGTTGAGATCCGCCGCAAGTACGTCCAGGATGGCAAGGTCATCGAGA

ACTCGTTCGCCGACTACGACACCCTCTCCCAGTTTAACTCCATCTCGGACGACTTCTGTGACGCTCAGAAGAC

TCTCTTTGGCGACAACAATGACTTCAAGACCAAGGGTGGTCTCTCTGTCATGGGTGAATCCCTCGCTCGCGGT

CAGGTCCTTGTTATGTCCATCTGGGACGACCATGCTGCGAACGCCCTCTGGCTCGACTCTAGCTACCCCACCG

ACGCCGATCCGAGCAAGCCTGGTGTCAAGCGTGGTCCTTGTGGCACTGATACTGGCAAGCCCGACGATGTTGA

GGCCCAGTACCCCGACAGCACTGTTGTCTACAGCAACATCCGCTACGGTGACATCGACTCCACCTACACTTCC

GCTTAAAGGGGAAATTTCTGTACGCGGATGGGCAAATATGAGGACAACCGCCGGGTAACTCAAACCAAAAGT

TCCCTCTACCTTTACTGTTTCGTAAGATGGATCTCTCAAGGCTCCCTTCCGCAATCCTCTCTCTACCTTCTAT

CATTCTAGAG

SEQ ID NO: 56
LENGTH: 528
TYPE: DNA
ORGANISM: M. phaseolina
FEATURE NAME/KEY: CDS
LOCATION: (1)...(528)
atgggcaatgagactttctacggcaccaacaacagcgtcatcgacaccaccaagaagttc
 M   G   N   E   T   F   Y   G   T   N   N   S   V   I   D   T   T   K   K   F accatcgtgacgcagttcattacttctgacaacaccgccgacggtgagctcgttgagatc
 T   I   V   T   Q   F   I   T   S   D   N   T   A   D   G   E   L   V   E   I cgccgcaagtacgtccaggatggcaaggtcatcgagaactcgttcgccgactacgacacc
 R   R   K   Y   V   Q   D   G   K   V   I   E   N   S   F   A   D   Y   D   T ctctcccagtttaactccatctcggacgacttctgtgacgctcagaagactctctttggc
 L   S   Q   F   N   S   I   S   D   D   F   C   D   A   Q   K   T   L   F   G gacaacaatgacttcaagaccaagggtggtctctctgtcatgggtgaatccctcgctcgc
 D   N   N   D   F   K   T   K   G   G   L   S   V   M   G   E   S   L   A   R ggtcaggtccttgttatgtccatctgggacgaccatgctgcgaacgccctctggctcgac
 G   Q   V   L   V   M   S   I   W   D   D   H   A   A   N   A   L   W   L   D tctagctaccccaccgacgccgatccgagcaagcctggtgtcaagcgtggtccttgtggc
 S   S   Y   P   T   D   A   D   P   S   K   P   G   V   K   R   G   P   C   G actgatactggcaagcccgacgatgttgaggcccagtaccccgacagcactgttgtctac
 T   D   T   G   K   P   D   D   V   E   A   Q   Y   P   D   S   T   V   V   Y agcaacatccgctacggtgacatcgactccacctacacttccgcttaa
 S   N   I   R   Y   G   D   I   D   S   T   Y   T   S   A   -

SEQ ID NO: 57
LENGTH: 175
TYPE: PRT
ORGANISM: M. phaseolina
MGNETFYGTNNSVIDTTKKFTIVTQFITSDNTADGELVEIRRKYVQDGKVIENSFADYDTLSQFNSISDDFCD

AQKTLFGDNNDFKTKGGLSVMGESLARGQVLVMSIWDDHAANALWLDSSYPTDADPSKPGVKRGPCGTDTGKP

DDVEAQYPDSTVVYSNIRYGDIDSTYTSA*

SEQ ID NO: 58
LENGTH: 2798 (including 150 bp 5' UTR and 150 bp 3' UTR)
TYPE: DNA
ORGANISM: M. phaseolina
CGCGTGGCATGGCACCGGGATTTCTTTCCAAGACCCCGAGCACGCCTGCCCGAGCCGTGCCCCCGCCCTGGCC

GTGAATAAGTAGTCCGCGAGTCCTCGCTGCTGAAGAGACTCCAAGGCAAGCCTGGACGATACTCCCGACAAGC

AACAATGGCTCCTCTCACCAACATGGCCGCGCTCCTGCTCGGCGCCGTAGCTGGCGCCGAGGCCGCTCAGGAC

TGGGATCACTCGCTGTACACCACCAGCCCGCCTGTCTACCCTTCGCCCAACATGACCGGCGTCGACTCAGCGT

CGCTGTCGGGTTGGGCCGGTGCTCTGGAGAAGGCTGAGGCCCTCCTCAGCAACCTGACCCTCGAGGAGAAGGT

CCTCATGCTCACTGGTGCTGCTGGTCCTTGCGTTGGGTATGATCGCTTTTCTCTTCCTCATCACGCACTCGCT

TACAGCCCTGCAGAAACATCGCACCCATCCCTCGCGTCGGCTTCAAGGGCCTCTGTCTCCAGGACGGTCCTCT

CGGCATCCGCCAGGCCGACTATGCCAGCGCTTTCCCCGCTGGTCTGAGTGCTGCCGCCTCCTTTGACAAGGAT

CTCATCCATGAGCGCGGAAAGCTCATTGGTGAGGAGTTCCGCGGCAAGGGTGCTCACATCTTCCTTGGCCCCG

TCGCTGGCCCGCTCGGCCGCAGCGCCATGGCTGGTCGTAACTGGGAGGGCTTCTCTCCCGATCCGTACCTCAC

TGGTGTTGCCATGGAGGAGACTATTCTCGGTGTCCAGAGCACCGGTGTCCAGGCCAACGCCAAGCACTGGGTC

GCCTACGAGCAGGAGACCCAGCGCAACCCCGAGGACGCTTTCGCCGCGTCGCACGAGCCGAACGACAAGGAGC

AGATGTCCGTCTCCTCCAACGTCGATGACCGCACCCTTCACGAGCTTTACGTTTGGCCCTTCGCCAACGCAAT

CCGTGCTGGTGTTTCCAGCGTCATGTGCGCCTACCAGCGCATCAACGGCTCTTACGCCTGCCAAAACTCCAAG

ACGCAGAACGGCATCCTCAAGACTGAGCTCGGCTTCCAGGGCTACGTCATGTCCGACTGGATGGGCACCCACA

GCGGCGTCGCTTCCGTCGAGGCTGGTTTGGACATGACGATGCCCGGTGCCTGGAACTGGCAGCCGTGGCTCAA

CTGGTCTACTCCCTCGTACTTTGGCGGCAACCTGACCAAGGCCGTCGAAAACGGCACCGTCTCTGTGACCCGT

-continued

GTCGACGACATGGTCAAGCGTGTCCTGACTCCTTACTACCTGCTTGGCCAGGACGAGGGCTTCCCCGGTGTTG

ACCCTTCTAGCGGCGCCTACCCTGCGGTTAACGACTTCCAGCCCGAGAGCAACTGGTACGACACCTGGAAGGC

TGCCGGTGCCCTCAACGATGAGGTCTCCGTCAATGTTCGTGGCAACCACAGCGAGCACATCCGCAAGCTAGGT

GCCGCTGGCTCTGTCCTCCTGAAGAACGTCAACAACACCCTTCCCCTCAAGAGCCCTAAGAAGATCGCCGTGT

TCGGCAACGCTGCTGGCGACCTCACCAACGGTCTCTACCCTAAAAGCAGCGACTATGAGTACGGCACTCTCCC

CGTTGGTGGTGGGTCTGGTACCTCCCGCTTCACCTCCGTCGTCGCCCCGCTCGATGCTATCAAGACGCGCGCT

AAGGCCGACGGTGCCACGGTCCAATACGTCCTGAACAACACGCTCCTGACCACCGCTGGTTCCTACGCCAGCA

AAATCTACCCCGAGCCTGACGTCTGCCTGGTCTTCGTCAAGACATGGGCCTCTGAAGGCGAGGACCGCGCCGA

CCTCAACCTCAACTGGGAGGGCAACGAGGTCATCGACCAGATTGCTGCCAATTGCAGCAACACCGTCGTCATC

TCCAACTCCGGCGGCCTCACTCTGATGCCCTGGGCCAACCACGAGAACGTCACCGCCATCCTGGCGGCCCACC

TGCCCGGCGAGGAGATCGGCAACTCGATCGTCGACATCCTGTACGGCGACGTCAATCCCTCGGGCAAGCTCCC

TTACACCATCGCCCACCAGGCCTCAGACTACTACTTCGCAAACATCACCACCTCGGTCGCCAACACCACCGAC

ACCGACGCCTGGCAGTCCGACTTCACCGAGCGCCTCCTCATCGACTACCGCTACTTTGACTATCACAACATCT

CCGTTCTCTACGAGTTCGGATTCGGCCTCTCCTACACCACCTTCGCCCTCGCCGACATCTCCATCTCCCCTGT

TTCCAACTCGTCCACCATCGCCGGCACCCCCGCCCCCACGACCGAGGTCGTCCCCGGCGGCAACCCCGCCCTC

TGGGACACGGTCTACAAGGTCACTGCCACGGTTAGCAACACGGGCGACCTCACCGGCGCCGCTGTCCCGCAGC

TGTACATCGAGCTGCCCGCCTCAGCCGGCGAGGGCACCCCCGTTAAGCAGCTGCGCGGCTTCGAGAAGGTCGA

GCTCGCCGCCGGCGAGAGCCAGCAGGTCACATTTGAGCTCATGCGTCGTGATCTGTCGGTTTGGGACGTCGTT

TCGCAGGAGTGGAGCGTGCCCAGCGGCACTTTTGGCGTGCACGTTGGCTTCTCCTCGAGGGATGTGCAGCTGA

AGGGGCAGTTTACTGTTTAACGAAGGGCTAAAGTGTATGATTTTGATGAATTAATTGTAAAAAGGATATGATT

GGGTTGAGTGGAGGTGGGAAGGGGAAGAGAGGGTTATGTGCTGTACCTACTAGTGATGGTATGGCTTTTAATG

ATAATGCGAATCTAGTATCATAGC

SEQ ID NO: 59
LENGTH: 2448
TYPE: DNA
ORGANISM: *M. phaseolina*
FEATURE NAME/KEY: CDS
LOCATION: (1)...(2448)

```
atggctcctctcaccaacatggccgcgctcctgctcggcgccgtagctggcgccgaggcc
 M  A  P  L  T  N  M  A  A  L  L  L  G  A  V  A  G  A  E  A gctcaggactgggatcactcgctgtacaccaccagcccgcctgtctacccttcgcccaac
 A  Q  D  W  D  H  S  L  Y  T  T  S  P  P  V  Y  P  S  P  N atgaccggcgtcgactcagcgtcgctgtcgggttgggccggtgctctggagaaggctgag
 M  T  G  V  D  S  A  S  L  S  G  W  A  G  A  L  E  K  A  E gccctcctcagcaacctgaccctcgaggagaaggtcctcatgctcactggtgctgctggt
 A  L  L  S  N  L  T  L  E  E  K  V  L  M  L  T  G  A  A  G ccttgcgttggaaacatcgcacccatccctcgcgtcggcttcaagggcctctgtctccag
 P  C  V  G  N  I  A  P  I  P  R  V  G  F  K  G  L  C  L  Q gacggtcctctcggcatccgccaggccgactatgccagcgctttccccgctggtctgagt
 D  G  P  L  G  I  R  Q  A  D  Y  A  S  A  F  P  A  G  L  S gctgccgcctcctttgacaaggatctcatccatgagcgcggaaagctcattggtgaggag
 A  A  A  S  F  D  K  D  L  I  H  E  R  G  K  L  I  G  E  E ttccgcggcaagggtgctcacatcttccttggccccgtcgctggcccgctcggccgcagc
 F  R  G  K  G  A  H  I  F  L  G  P  V  A  G  P  L  G  R  S gccatggctggtcgtaactgggagggcttctctcccgatccgtacctcactggtgttgcc
 A  M  A  G  R  N  W  E  G  F  S  P  D  P  Y  L  T  G  V  A atggaggagactattctcggtgtccagagcaccggtgtccaggccaacgccaagcactgg
 M  E  E  T  I  L  G  V  Q  S  T  G  V  Q  A  N  A  K  H  W
```

-continued

```
gtcgcctacgagcaggagacccagcgcaaccccgaggacgctttcgccgcgtcgcacgag
 V  A  Y  E  Q  E  T  Q  R  N  P  E  D  A  F  A  A  S  H  E ccgaacgacaaggagcagatgtccgtctcctccaacgtcgatgaccgcacccttcacgag
 P  N  D  K  E  Q  M  S  V  S  S  N  V  D  D  R  T  L  H  E ctttacgtttggcccttcgccaacgcaatccgtgctggtgtttccagcgtcatgtgcgcc
 L  Y  V  W  P  F  A  N  A  I  R  A  G  V  S  S  V  M  C  A taccagcgcatcaacggctcttacgcctgccaaaactccaagacgcagaacggcatcctc
 Y  Q  R  I  N  G  S  Y  A  C  Q  N  S  K  T  Q  N  G  I  L aagactgagctcggcttccagggctacgtcatgtccgactggatgggcacccacagcggc
 K  T  E  L  G  F  Q  G  Y  V  M  S  D  W  M  G  T  H  S  G gtcgcttccgtcgaggctggtttggacatgacgatgcccgtgcctggaactggcagccg
 V  A  S  V  E  A  G  L  D  M  T  M  P  G  A  W  N  W  Q  P tggctcaactggtctactccctcgtactttggcggcaacctgaccaaggccgtcgaaaac
 W  L  N  W  S  T  P  S  Y  F  G  G  N  L  T  K  A  V  E  N ggcaccgtctctgtgaccgtgtcgacgacatggtcaagcgtgtcctgactccttactac
 G  T  V  S  V  T  R  V  D  D  M  V  K  R  V  L  T  P  Y  Y ctgcttggccaggacgagggcttcccggtgttgaccttctagcggcgcctaccctgcg
 L  L  G  Q  D  E  G  F  P  G  V  D  P  S  S  G  A  Y  P  A gttaacgacttccagcccgagagcaactggtacgacacctggaaggctgccggtgccctc
 V  N  D  F  Q  P  E  S  N  W  Y  D  T  W  K  A  A  G  A  L aacgatgaggtctccgtcaatgttcgtggcaaccacagcgagcacatccgcaagctaggt
 N  D  E  V  S  V  N  V  R  G  N  H  S  E  H  I  R  K  L  G gccgctggctctgtcctcctgaagaacgtcaacaacacccttcccctcaagagccctaag
 A  A  G  S  V  L  L  K  N  V  N  N  T  L  P  L  K  S  P  K aagatcgccgtgttcggcaacgctgctggcgacctcaccaacggtctctaccctaaaagc
 K  I  A  V  F  G  N  A  A  G  D  L  T  N  G  L  Y  P  K  S agcgactatgagtacggcactctccccgttggtggtgggtctggtacctcccgcttcacc
 S  D  Y  E  Y  G  T  L  P  V  G  G  G  S  G  T  S  R  F  T tccgtcgtcgccccgctcgatgctatcaagacgcgcgctaaggccgacggtgccacggtc
 S  V  V  A  P  L  D  A  I  K  T  R  A  K  A  D  G  A  T  V caatacgtcctgaacaacacgctcctgaccaccgctggttcctacgccagcaaaatctac
 Q  Y  V  L  N  N  T  L  L  T  T  A  G  S  Y  A  S  K  I  Y cccgagcctgacgtctgcctggtcttcgtcaagacatgggcctctgaaggcgaggaccgc
 P  E  P  D  V  C  L  V  F  V  K  T  W  A  S  E  G  E  D  R gccgacctcaacctcaactgggagggcaacgaggtcatcgaccagattgctgccaattgc
 A  D  L  N  L  N  W  E  G  N  E  V  I  D  Q  I  A  A  N  C agcaacaccgtcgtcatctccaactccggcggcctcactctgatgccctgggccaaccac
 S  N  T  V  V  I  S  N  S  G  G  L  T  L  M  P  W  A  N  H gagaacgtcaccgccatcctggcggcccacctgcccggcgaggagatcggcaactcgatc
 E  N  V  T  A  I  L  A  A  H  L  P  G  E  E  I  G  N  S  I gtcgacatcctgtacggcgacgtcaatccctcgggcaagctcccttacaccatcgcccac
 V  D  I  L  Y  G  D  V  N  P  S  G  K  L  P  Y  T  I  A  H caggcctcagactactacttcgcaaacatcaccacctcggtcgccaacaccaccgacacc
 Q  A  S  D  Y  Y  F  A  N  I  T  T  S  V  A  N  T  T  D  T gacgcctggcagtccgacttcaccgagcgcctcctcatcgactaccgctactttgactat
 D  A  W  Q  S  D  F  T  E  R  L  L  I  D  Y  R  Y  F  D  Y cacaacatctccgttctctacgagttcggattcggcctctcctacaccaccttcgccctc
 H  N  I  S  V  L  Y  E  F  G  F  G  L  S  Y  T  T  F  A  L gccgacatctccatctcccctgtttccaactcgtccaccatcgccggcacccccgccccc
 A  D  I  S  I  S  P  V  S  N  S  S  T  I  A  G  T  P  A  P acgaccgaggtcgtccccggcggcaacccgccctctgggacacggtctacaaggtcact
 T  T  E  V  V  P  G  G  N  P  A  L  W  D  T  V  Y  K  V  T gccacggttagcaacacgggcgacctcaccggcgccgctgtcccgcagctgtacatcgag
 A  T  V  S  N  T  G  D  L  T  G  A  A  V  P  Q  L  Y  I  E
```

```
ctgcccgcctcagccggcgagggcaccccccgttaagcagctgcgcggcttcgagaaggtc
 L   P   A   S   A   G   E   G   T   P   V   K   Q   L   R   G   F   E   K   V gagctcgccgccggcgagagccagcaggtcacatttgagctcatgcgtcgtgatctgtcg
 E   L   A   A   G   E   S   Q   Q   V   T   F   E   L   M   R   R   D   L   S gtttgggacgtcgtttcgcaggagtggagcgtgcccagcggcacttttggcgtgcacgtt
 V   W   D   V   V   S   Q   E   W   S   V   P   S   G   T   F   G   V   H   V ggcttctcctcgagggatgtgcagctgaaggggcagtttactgtttaa
 G   F   S   S   R   D   V   Q   L   K   G   Q   F   T   V   -
```

SEQ ID NO: 60
LENGTH: 815
TYPE: PRT
ORGANISM: M. phaseolina

MAPLTNMAALLLGAVAGAEAAQDWDHSLYTTSPPVYPSPNMTGVDSASLSGWAGALEKAEALLSNLTLEEKVL

MLTGAAGPCVGNIAPIPRVGFKGLCLQDGPLGIRQADYASAFPAGLSAAASFDKDLIHERGKLIGEEFRGKGA

HIFLGPVAGPLGRSAMAGRNWEGFSPDPYLTGVAMEETILGVQSTGVQANAKHWVAYEQETQRNPEDAFAASH

EPNDKEQMSVSSNVDDRTLHELYVWPFANAIRAGVSSVMCAYQRINGSYACQNSKTQNGILKTELGFQGYVMS

DWMGTHSGVASVEAGLDMTMPGAWNWQPWLNWSTPSYFGGNLTKAVENGTVSVTRVDDMVKRVLTPYYLLGQD

EGFPGVDPSSGAYPAVNDFQPESNWYDTWKAAGALNDEVSVNVRGNHSEHIRKLGAAGSVLLKNVNNTLPLKS

PKKIAVFGNAAGDLTNGLYPKSSDYEYGTLPVGGGSGTSRFTSVVAPLDAIKTRAKADGATVQYVLNNTLLTT

AGSYASKIYPEPDVCLVFVKTWASEGEDRADLNLNWEGNEVIDQIAANCSNTVVISNSGGLTLMPWANHENVT

AILAAHLPGEEIGNSIVDILYGDVNPSGKLPYTIAHQASDYYFANITTSVANTTDTDAWQSDFTERLLIDYRY

FDYHNISVLYEFGFGLSYTTFALADISISPVSNSSTIAGTPAPTTEVVPGGNPALWDTVYKVTATVSNTGDLT

GAAVPQLYIELPASAGEGTPVKQLRGFEKVELAAGESQQVTFELMRRDLSVWDVVSQEWSVPSGTFGVHVGFS

SRDVQLKGQFTV*

SEQ ID NO: 61
LENGTH: 3140 (including 150 bp 5' UTR and 150 bp 3' UTR)
TYPE: DNA
ORGANISM: M. phaseolina
GAGCGTCACGGAATGACACGGTGGGGAGTGCACGGCGACAAGCCTCCCCCCCAAACCATGGCTGATACAAGA

ATACGCTCGCTCGCTCCAACAGCCCTTCCACCTGAACTCTTGCCCGCTTTCTTCGTTTTGATATCCTTCCTTC

CGCCATGGCCCCTCCCGCTGATGTTGAGGCCATCCTCGCCTCGTTGACGTTGGATGAGAAGGTCAGTTGCTCA

GTTGCTTTATTTCTCTCCAAAACTCCTCCAGCGTTCACATAACCTCTACATCCTCCGCCAACCCGAGTCAGAG

GGAGCCACCAATCAGCGAATCAGGAATCCCCAGTTGAGGCGTCGATGCGACGGAGGCTGTGTAACCTTTCGAT

TCGAAGTGTATCGCCAAAGCCGACATTCATTCGGGCTTGTCTTCCGCCTCCTCACTATTTTGACTTTCCAGTT

CTTAGGGAGCTCCGTTGAACAGGCCATGCTGACCAGCCGCAGATCTCTCTCCTCGCCGGCGCAAACTTCTGGG

AAACCGTGGCCATCCCCTCCAAGGGCATCCCCTCCCTGAAGACCAGCGACGGCCCCAACGGTGCCCGCGGCGC

CGAATTTGCCCACGGCACCACCGCCGCCTGCTTCCCGGCGTCGGTCTGCCTGGCCTCGACCTTCGACGTCGAC

CTCGCCGCGCAAGTTGGCGCAGCGCTGGCCGAGGAGACGCAGAGCAAGGGCGCGCGCGTGCTGCTGGCTCCCA

CCGTCTGCCTGCACCGCCATCCGCTCGGCGGCCGCAACTTCGAGTCCTTCTCCGAGGACCCCCTGCTTGCCGG

CAAGCTGGCCGCGGCGTACATCGCCGGCTTGCAGGCCAAGGGCGTTGGCGCAACGATCAAGCACTTCGCCGCA

AACGAGCAGGAGACCCAGCGCTTTACCGTCAACGAGACCATCTCGGAGCGCGCGCTGCGCGAGTTGTATCTCA

AGCCTTTCGAGATTGCGATCAAGGAGGCGAATCCGTGGGCGGTCATGACGAGCTACAACCTCGTGAATGGCAC

GCATGCGGATAGCAGCGACTTCCTGCTGAAGAAGGTGCTGAGAGGGGATTGGGGGTGGAAGGGACTGGTCATG

AGCGATTGGGGTGGCACGAACTCGACTGCCGAGAGCATCAACGCCGGTATGGATCTGGAAATGCCGGGCCCCA

CCAAGTGGCGCAAAGTCGACGATGTGAAGGCGGCTATCGCGGCGGGTAAGACGAGCGAGGAGGCGGTGACGGC

GAGGGCGCGCAACGTGCTGGAGCTGCTGGTCAAGACGCGTCAGTTTGAGGATCCGGTCACGCCGCCGGAGCAG

GCCATCAACAGGCCATCCACCCAGAAGCTTATCAGGCAGGTTGGTGGATCGGGTGCGGTGCTGCTGAAGAATG

-continued

```
AGGGGGCCGTGCTGCCGATTAAGAAGGAGAACTTGCGGAAGAAGAGGATTGCGTTGTTGGGCCATGCCAAGGA
TTCGTTGATTCATGGCGGGGGgAGTGCGTCTGTCAACGCTCATTACAAAATTACTCCCTACGACGGCTTGAAG
GCAGCTCTTGGGGATGATGTGGAGCTCGTGTACGCAAAGGGTAGGTTCAGGCTCGACTTCATCACCGATTAGC
CGCCAGCTAATCAATCGCGACAGGCGCACACGATTTCCGTCTCCTTCCATCCATGGGCAAGGGCGTCAAGGAC
TATGAAGGATCCGCCGGCTGGACTCTTCAACGGTTCGACACCGAGGACTACACCAAATCACCCGTCGGTACCA
AGAACATACCCACGTCTCACTGGGCGCCCATTCTCTCCACAGAAGCCACGGAAGCGGCAAAGCTGACAGGAAC
ATTCACTGCTGAAACTTCGGGCAAGCACTACCTTGGCTTCTCCGGCCTTGGGCCGTCGAAGCTCTTTATCAAC
GGCGAACTGGTTTCGGAGCAGAAGCACAACTACCAGGACCCGATGGGCTTCCTGCTAGGCGGAGGCAAGCAGG
AAAACTTCCAGTACTACTTCGAGGCAGGCAAGCAATACGCCATCGAGGTGCAGTCGCGGCGGCCGCAAGTCAA
CAACAGCGGTCTCAGTATCCTGGACAAATGCATGGGCTTCTACCTCGGCTTCATGACGGAAGCGGAGCACGAC
GAGGACATCCAAGGCCAAGCCGTCGCAGCTGCGCGCGACGCCGACGTGGCCATCGTGTTCACCGGCCACACCA
AGGACTGGGAGACGGAGGGCCAGGACCAGGCGAGTTTCCACCTGCCGGCTGACGGCTCGCAGGACGCGCTCGT
CGCGGCCATCGCCGCCGCCAATGCGAACACGGTCGTTGTCAACAACACCGGCGTCGCCGTCGCCATGCCCTGG
ATCGACGGGGTCGCTGCCGTCGTCCAGGCCTGGTTCCCCGGCCAGGAGGCCGGCAACGCCATCGCCGACGTGT
TACTGGGCAAGGTCAACCCCTCGGGCCGCTTGCCGACGAGCTTCCCCCGCCGCCTCGAGGATGCGCCCGCGCA
CGGCAATTTCCCGGGCGAGTACGTGGATGGCCGGCTGGAGGTCAGGTATGCGGAGGACGTGTTCATCGGGTAC
AGGCACTACGACCGCGTGGATAGGAGTAAGGTACTGTTCCCGTTCGGCTTCGGCCTCAGCTACACGACTTTCG
CGCTGTCGGGCTTCTACGTCCAGCAGAACGAGGACGTCGTCGACGTCGCTGTCAGCGTGCAGAATACGGGCGG
TGTGGCGGGCGCGCAGGTGGTGCAGATTTACGCGGGCCCGGAGGGCAAGAGGCGCGTCGAGTGTCCGGTGAAA
CAGTTGGTTGGGTTTAAGCGCGTTGAGGTGCAGCCGGGTGAGACGAAGGCGGTGCAGGTACCGGTGCCGGTGA
GGAGCTTGGCGTACTTTGAGGAGGCCAGGGGGAAGTGGGTTGTGGAGAAGGGCGAGTATAGGATCTCGGTGGC
GGAGTCGTCGGTTGATGTTAGGGAGAGTACTGTTATTACTGTGGAGAAGGAATTGGAGTTTGCGCCTTGAGCG
TTGTGCTGAAGGTTGGGGATGTCTGGACAGGGGGACGGAATGTTTGGTAGCTGAGGAGTTTGGGTGTCGGAAG
GGTGCTATCGAGGTCAGATTAGGGTGTGCAAGCTGGCTAATGGCTGAACTGTGCGGCAGGTGATTGGGTGGCG
A
```

SEQ ID NO: 62
LENGTH: 2511
TYPE: DNA
ORGANISM: M. phaseolina
FEATURE NAME/KEY: CDS
LOCATION: (1)...(2511)

```
atggcccctcccgctgatgttgaggccatcctcgcctcgttgacgttggatgagaagatc
 M   A   P   P   A   D   V   E   A   I   L   A   S   L   T   L   D   E   K   I tctctcctcgccggcgcaaacttctgggaaaccgtggccatcccctccaagggcatcccc
 S   L   L   A   G   A   N   F   W   E   T   V   A   I   P   S   K   G   I   P tccctgaagaccagcgacggccccaacggtgcccgcggcgccgaatttgcccacggcacc
 S   L   K   T   S   D   G   P   N   G   A   R   G   A   E   F   A   H   G   T accgccgcctgcttcccggcgtcggtctgcctggcctcgaccttcgacgtcgacctcgcc
 T   A   A   C   F   P   A   S   V   C   L   A   S   T   F   D   V   D   L   A gcgcaagttggcgcagcgctggccgaggagacgcagagcaagggcgcgcgcgtgctgctg
 A   Q   V   G   A   A   L   A   E   E   T   Q   S   K   G   A   R   V   L   L gctcccaccgtctgcctgcaccgccatccgctcggcggccgcaacttcgagtccttctcc
 A   P   T   V   C   L   H   R   H   P   L   G   G   R   N   F   E   S   F   S gaggaccccctgcttgccggcaagctggccgcggcgtacatcgccggcttgcaggccaag
 E   D   P   L   L   A   G   K   L   A   A   A   Y   I   A   G   L   Q   A   K ggcgttggcgcaacgatcaagcacttcgccgcaaacgagcaggagacccagcgctttacc
 G   V   G   A   T   I   K   H   F   A   A   N   E   Q   E   T   Q   R   F   T
```

```
gtcaacgagaccatctcggagcgcgcgctgcgcgagttgtatctcaagcctttcgagatt
 V  N  E  T  I  S  E  R  A  L  R  E  L  Y  L  K  P  F  E  I gcgatcaaggaggcgaatccgtgggcggtcatgacgagctacaacctcgtgaatggcacg
 A  I  K  E  A  N  P  W  A  V  M  T  S  Y  N  L  V  N  G  T catgcggatagcagcgacttcctgctgaagaaggtgctgagaggggattgggggtggaag
 H  A  D  S  S  D  F  L  L  K  K  V  L  R  G  D  W  G  W  K ggactggtcatgagcgattggggtggcacgaactcgactgccgagagcatcaacgccggt
 G  L  V  M  S  D  W  G  G  T  N  S  T  A  E  S  I  N  A  G atggatctggaaatgccgggccccaccaagtggcgcaaagtcgacgatgtgaaggcggct
 M  D  L  E  M  P  G  P  T  K  W  R  K  V  D  D  V  K  A  A atcgcggcgggtaagacgagcgaggaggcggtgacggcgagggcgcgcaacgtgctggag
 I  A  A  G  K  T  S  E  E  A  V  T  A  R  A  R  N  V  L  E ctgctggtcaagacgcgtcagtttgaggatccggtcacgccgccggagcaggccatcaac
 L  L  V  K  T  R  Q  F  E  D  P  V  T  P  P  E  Q  A  I  N aggccatccacccagaagcttatcaggcaggttggtggatcgggtcgcggtgctgctgaag
 R  P  S  T  Q  K  L  I  R  Q  V  G  G  S  G  A  V  L  L  K aatgaggggccgtgctgccgattaagaaggagaacttgcggaagaagaggattgcgttg
 N  E  G  A  V  L  P  I  K  K  E  N  L  R  K  K  R  I  A  L ttgggccatgccaaggattcgttgattcatggcgggggagtgcgtctgtcaacgctcat
 L  G  H  A  K  D  S  L  I  H  G  G  G  S  A  S  V  N  A  H tacaaaattactccctacgacggcttgaaggcagctcttggggatgatgtggagctcgtg
 Y  K  I  T  P  Y  D  G  L  K  A  A  L  G  D  D  V  E  L  V tacgcaaagggcgcacacgatttccgtctccttccatccatgggcaagggcgtcaaggac
 Y  A  K  G  A  H  D  F  R  L  L  P  S  M  G  K  G  V  K  D tatgaaggatccgccggctggactcttcaacggttcgacaccgaggactacaccaaatca
 Y  E  G  S  A  G  W  T  L  Q  R  F  D  T  E  D  Y  T  K  S cccgtcggtaccaagaacatacccacgtctcactgggcgcccattctctccacagaagcc
 P  V  G  T  K  N  I  P  T  S  H  W  A  P  I  L  S  T  E  A acggaagcggcaaagctgacaggaacattcactgctgaaacttcgggcaagcactaccttt
 T  E  A  A  K  L  T  G  T  F  T  A  E  T  S  G  K  H  Y  L ggcttctccggccttgggccgtcgaagctctttatcaacggcgaactggtttcggagcag
 G  F  S  G  L  G  P  S  K  L  F  I  N  G  E  L  V  S  E  Q aagcacaactaccaggacccgatgggcttcctgctaggcggaggcaagcaggaaaacttc
 K  H  N  Y  Q  D  P  M  G  F  L  L  G  G  G  K  Q  E  N  F cagtactacttcgaggcaggcaagcaatacgccatcgaggtgcagtcgcggcggccgcaa
 Q  Y  Y  F  E  A  G  K  Q  Y  A  I  E  V  Q  S  R  R  P  Q gtcaacaacagcggtctcagtatcctggacaaatgcatgggcttctacctcggcttcatg
 V  N  N  S  G  L  S  I  L  D  K  C  M  G  F  Y  L  G  F  M acggaagcggagcacgacgaggacatccaaggccaagccgtcgcagctgcgcgcgacgcc
 T  E  A  E  H  D  E  D  I  Q  G  Q  A  V  A  A  A  R  D  A gacgtggccatcgtgttcaccggccacaccaaggactgggagacggagggccaggaccag
 D  V  A  I  V  F  T  G  H  T  K  D  W  E  T  E  G  Q  D  Q gcgagtttccacctgccggctgacggctcgcaggacgcgctcgtcgcggccatcgccgcc
 A  S  F  H  L  P  A  D  G  S  Q  D  A  L  V  A  A  I  A  A gccaatgcgaacacggtcgttgtcaacaacaccggcgtcgccgtcgccatgccctggatc
 A  N  A  N  T  V  V  V  N  N  T  G  V  A  V  A  M  P  W  I gacggggtcgctgccgtcgtccaggcctggttccccggccaggaggccggcaacgccatc
 D  G  V  A  A  V  V  Q  A  W  F  P  G  Q  E  A  G  N  A  I gccgacgtgttactgggcaaggtcaacccctcgggccgcttgccgacgagcttcccccgc
 A  D  V  L  L  G  K  V  N  P  S  G  R  L  P  T  S  F  P  R cgcctcgaggatgcgcccgcgcacggcaatttcccgggcgagtacgtggatggccggctg
 R  L  E  D  A  P  A  H  G  N  F  P  G  E  Y  V  D  G  R  L gaggtcaggtatgcggaggacgtgttcatcgggtacaggcactacgaccgcgtggatagg
 E  V  R  Y  A  E  D  V  F  I  G  Y  R  H  Y  D  R  V  D  R
```

-continued

```
agtaaggtactgttcccgttcggcttcggcctcagctacacgactttcgcgctgtcgggc
 S  K  V  L  F  P  F  G  F  G  L  S  Y  T  T  F  A  L  S  G ttctacgtccagcagaacgaggacgtcgtcgacgtcgctgtcagcgtgcagaatacgggc
 F  Y  V  Q  Q  N  E  D  V  V  D  V  A  V  S  V  Q  N  T  G ggtgtggcgggcgcgcaggtggtgcagatttacgcgggcccggagggcaagaggcgcgtc
 G  V  A  G  A  Q  V  V  Q  I  Y  A  G  P  E  G  K  R  R  V gagtgtccggtgaaacagttggttgggtttaagcgcgttgaggtgcagccgggtgagacg
 E  C  P  V  K  Q  L  V  G  F  K  R  V  E  V  Q  P  G  E  T aaggcggtgcaggtaccggtgccggtgaggagcttggcgtactttgaggaggccagggg
 K  A  V  Q  V  P  V  P  V  R  S  L  A  Y  F  E  E  A  R  G aagtggttgtggagaagggcgagtataggatctcggtggcggagtcgtcggttgatgtt
 K  W  V  V  E  K  G  E  Y  R  I  S  V  A  E  S  S  V  D  V agggagagtactgttattactgtggagaaggaattggagtttgcgccttga
 R  E  S  T  V  I  T  V  E  K  E  L  E  F  A  P  -
```

SEQ ID NO: 63
LENGTH: 836
TYPE: PRT
ORGANISM: M. phaseolina

MAPPADVEAILASLTLDEKISLLAGANFWETVAIPSKGIPSLKTSDGPNGARGAEFAHGTTAACFPASVCLAS

TFDVDLAAQVGAALAEETQSKGARVLLAPTVCLHRHPLGGRNFESFSEDPLLAGKLAAAYIAGLQAKGVGATI

KHFAANEQETQRFTVNETISERALRELYLKPFEIAIKEANPWAVMTSYNLVNGTHADSSDFLLKKVLRGDWGW

KGLVMSDWGGTNSTAESINAGMDLEMPGPTKWRKVDDVKAAIAAGKTSEEAVTARARNVLELLVKTRQFEDPV

TPPEQAINRPSTQKLIRQVGGSGAVLLKNEGAVLPIKKENLRKKRIALLGHAKDSLIHGGGSASVNAHYKITP

YDGLKAALGDDVELVYAKGAHDFRLLPSMGKGVKDYEGSAGWTLQRFDTEDYTKSPVGTKNIPTSHWAPILST

EATEAAKLTGTFTAETSGKHYLGFSGLGPSKLFINGELVSEQKHNYQDPMGFLLGGGKQENFQYYFEAGKQYA

IEVQSRRPQVNNSGLSILDKCMGFYLGFMTEAEHDEDIQGQAVAAARDADVAIVFTGHTKDWETEGQDQASFH

LPADGSQDALVAAIAAANANTVVVNNTGVAVAMPWIDGVAAVVQAWFPGQEAGNAIADVLLGKVNPSGRLPTS

FPRRLEDAPAHGNFPGEYVDGRLEVRYAEDVFIGYRHYDRVDRSKVLFPFGFGLSYTTFALSGFYVQQNEDVV

DVAVSVQNTGGVAGAQVVQIYAGPEGKRRVECPVKQLVGFKRVEVQPGETKAVQVPVPVRSLAYFEEARGKWV

VEKGEYRISVAESSVDVRESTVITVEKELEFAP*

SEQ ID NO: 64
LENGTH: 2696 (including 150 bp 5' UTR and 150 bp 3' UTR)
TYPE: DNA
ORGANISM: M. phaseolina

TGGTCTGGTTCATCTTTGCTAGGCCATGCCGCGGGGTTCATCCTCCGGCGTCGGCACAGTGCCACCCAAATTG

TTTTATAAACATCGTGTGAGACCTCGTCCTGTGCCGGTCGTTACGGTTCATCGTAGTTGTTCAATTCCAAAGG

AGCAATGGTTAACTCATACTCCTTGCTCCTAGCCATTGCCGCCTTTGGCACTGCTACTCCAGTCCGCAGACAG

GGTGAGCTATTTTCTTTCTTGCCTTCCCATACGACACCCTTCTGACGCGATAAATCAGCCGCTGGTGACTGGG

ATGCTGCGTATGCTCAAGCAGAGGCTTCTCTTGCGCAATTGAACCAAGATGAGAAAGTCGGGATAGTCACAGG

AGTCGGATGGCAGAATGGGCCCTGCGTTGGAAATACCTCGCCCGTACCGAAGATCGGTTATCCTTCTCTCTGT

CTGCAGGATGGCCCCCTCGGAATCAGATTTGCGCAAGGAGTTACTGCGTTCCCAGCTGGCGTCCATGCAGCTT

CGACTTGGGACAAGAGCTTGATCCACGAGAGAGGCGTTGCCATGGGAGCAGAGGCCAAAGGCTTGGGCATTCA

CGTACAACTTGGTCCCGTAGCTGGACCTCTTGGCAAGGTGCGTCTCATCCTCACTGACTTCTATCGTAGTTGG

TGCTCACTGTTGTTAGATTCCACAAGGAGGCCGTAACTGGGAAGGCTTTTCTCCTGACCCATACCTTACCGGT

ATTGCCATGCATGAGACCATTACCGGCATGCAGTCCTCGGGCGTACAAGCCTGTGCTAAGCACTACATTGGCA

ACGAACAAGAACTCAACCGCAACACCATGTCTTCCAACATTGACGACCGTACCATGCACGAGCTCTACCTCTG

GCCCTTCGCCGATGCCGTCAAAGCCAACGTCGCCAACTTTATGTGCTCGTACAATAAGCTTGATGGTGTCTGG

GCATGCGAAAATGACCACATTCTCAACAGCCTTCTCAAAGAGGAGCTCGAATTCCGCGGCTACGTCCTCAGCG

-continued

```
ATTGGAATGCGCAACACTCGACGGTGCTCAGCGCGAACTCCGGCCTGGACATGACGATGCCAGGCGACGACTT
TGCCGGCGGAAGCATCTATTGGGGACCCAACCTCACTGCTGCCATCGCCGCTGGCCAAGTCCCACAGTCCCGC
CTCGATGATATGGTCAAGCGCATCCTGGCCGCCTGGTACCTCCTCGGCCAGGACGAAGGTTACCCCCCAACTC
TTTTCTCTTCCTGGAACGGCGGCACTGGTGGCCCTGACGTGCAGGCCGACCACAAGAACGTCGCCCGTGCTAT
TGCCCGTGATGGCACCATCCTCCTGAAGAACGACAATGCCACTCTCCCCCTAAAAGCCCCTGCCTCCCTCGCA
ATCATCGGCCAGGACGCCATCGTCAATCCAGCCGGCCCCAACGCCTGCGCCGACCGCGCTTGCAATACTGGCC
ACCTCGCCATGGGCTGGGGGTCCGGCACCACCGAATTCCCCTACCTAATTGCGCCCCTCGACGCCATCCGCCC
CCGCGCTGAAGCAGCAGGCACGACTCTGACCCTCTCCACAACCGACGACCAAGCCAGCGCCGCCTCAGCCGCT
GCGGCCGCCGAGACGGCCATCGTCTTCATCACGGCCGACTCGGGTGAGGAGTACCTCACCGTCGAGGGCAATG
CGGGCGACCGCCTCAACCTCGACCCGTGGCACGACGGCAACGGCCTCGTCCGCGCCGCCGCCTCCGCCGGTAA
GCCCGTCATTGTCGTCGCGCACAGCGTCGGCCCCATCATCCTCGAGGATATTCTCAGCCATGACAACGTCGTC
GCCGTCGTCTGGGGCGGCATTGCCGGCCAGGAGAGCGGCAATGGCCTCGCTGATGTGCTGTATGGCGACGTCA
GTCCGAGTGGGAAGCTGCCGTATACGATTGCTAAGGCGGCGGGTGATTATGGGACACAGCTGGAGCCTGGTGA
CGACAACTTCGAGGAGGGCTTGTATATCGATTATCGGCATTTCGATAAGGCGGGTATCGAGCCAAGATATGAG
TTTGGGTTTGGGTTGTGTGAGTTTTGCCCCTTTTCTCCCTCTCCCCTCTCCCTCTCACCCCTTGAGAAATAAT
CGGTGACCGACTGACCGATGACCACCAGCGTACACGAACTTCACCTACACCGACCTCGTCGCCACCGCCACGG
GCGGCCCTTCCTACGGCGCGGCTTCCGCAGCAGCGACGGACCCCTACGCCCCGCTCGCCACCGTCACGGTGAC
CATCACCAACAGCGGCGACGTCGCTGGCGCCGAGGTCGCGCAGCTGTACCTCTCGCTGCCCGCGTCGGCCGGC
GTCGACGCCCCGCTGCGCCAGCTGCGCGGCTTCGAGAAGCTCGACCTCGCGCCGGGCGAGAGTGGCACGGTCG
AGTTCGTGCTCCGCCGCAAGGACGCTAGCTACTGGGATGTGGCGGCGCAGCAGTGGGTGCTGCCGGCCGGTGA
GTTCGCGATTGCGGTGGGTGCAAGCTCGAGGGATTTGAGATTGCAGGGGTCGTTGACTGTTTGAGCTGGGTAG
GGAGACGGGTCGGGGTTGCGCGGAGAAGGAACTGTAGATTTGAGATCGTTACGACATGATTTGAGATGCGTGT
ATAAGAGGGAACAGAAAAGAGAAATAGCAAGAGAACATTCGCTACGTCCAACCACCTTGATTCTCCCC
```

```
SEQ ID NO: 65
LENGTH: 2202
TYPE: DNA
ORGANISM: M. phaseolina
FEATURE NAME/KEY: CDS
LOCATION: (1)...(2202)
atggttaactcatactccttgctcctagccattgccgcctttggcactgctactccagtc
 M   V   N   S   Y   S   L   L   L   A   I   A   A   F   G   T   A   T   P   V cgcagacaggccgctggtgactgggatgctgcgtatgctcaagcagaggcttctcttgcg
 R   R   Q   A   A   G   D   W   D   A   A   Y   A   Q   A   E   A   S   L   A caattgaaccaagatgagaaagtcgggatagtcacaggagtcggatggcagaatgggccc
 Q   L   N   Q   D   E   K   V   G   I   V   T   G   V   G   W   Q   N   G   P tgcgttggaaatacctcgcccgtaccgaagatcggttatccttctctctgtctgcaggat
 C   V   G   N   T   S   P   V   P   K   I   G   Y   P   S   L   C   L   Q   D ggcccccctcggaatcagatttgcgcaaggagttactgcgttcccagctggcgtccatgca
 G   P   L   G   I   R   F   A   Q   G   V   T   A   F   P   A   G   V   H   A gcttcgacttgggacaagagcttgatccacgagagaggcgttgccatgggagcagaggcc
 A   S   T   W   D   K   S   L   I   H   E   R   G   V   A   M   G   A   E   A aaaggcttgggcattcacgtacaacttggtccgtagctggacctcttggcaagattcca
 K   G   L   G   I   H   V   Q   L   G   P   V   A   G   P   L   G   K   I   P caaggaggccgtaactgggaaggcttttctcctgacccatacctaccggtattgccatg
 Q   G   G   R   N   W   E   G   F   S   P   D   P   Y   L   T   G   I   A   M catgagaccattaccggcatgcagtcctcgggcgtacaagcctgtgctaagcactacatt
 H   E   T   I   T   G   M   Q   S   S   G   V   Q   A   C   A   K   H   Y   I ggcaacgaacaagaactcaaccgcaacaccatgtcttccaacattgacgaccgtaccatg
 G   N   E   Q   E   L   N   R   N   T   M   S   S   N   I   D   D   R   T   M
```

```
cacgagctctacctctggcccttcgccgatgccgtcaaagccaacgtcgccaactttatg
 H  E  L  Y  L  W  P  F  A  D  A  V  K  A  N  V  A  N  F  M tgctcgtacaataagcttgatggtgtctgggcatgcgaaaatgaccacattctcaacagc
 C  S  Y  N  K  L  D  G  V  W  A  C  E  N  D  H  I  L  N  S cttctcaaagaggagctcgaattccgcggctacgtcctcagcgattggaatgcgcaacac
 L  L  K  E  E  L  E  F  R  G  Y  V  L  S  D  W  N  A  Q  H tcgacggtgctcagcgcgaactccggcctggacatgacgatgccaggcgacgactttgcc
 S  T  V  L  S  A  N  S  G  L  D  M  T  M  P  G  D  D  F  A ggcggaagcatctattggggacccaacctcactgctgccatcgccgctggccaagtccca
 G  G  S  I  Y  W  G  P  N  L  T  A  A  I  A  A  G  Q  V  P cagtcccgcctcgatgatatggtcaagcgcatcctggccgcctggtacctcctcggccag
 Q  S  R  L  D  D  M  V  K  R  I  L  A  A  W  Y  L  L  G  Q gacgaaggttaccccccaactctttctcttcctggaacggcggcactggtggccctgac
 D  E  G  Y  P  P  T  L  F  S  S  W  N  G  G  T  G  G  P  D gtgcaggccgaccacaagaacgtcgcccgtgctattgcccgtgatggcaccatcctcctg
 V  Q  A  D  H  K  N  V  A  R  A  I  A  R  D  G  T  I  L  L aagaacgacaatgccactctcccccctaaaagcccctgcctccctcgcaatcatcggccag
 K  N  D  N  A  T  L  P  L  K  A  P  A  S  L  A  I  I  G  Q gacgccatcgtcaatccagccggccccaacgcctgcgccgaccgcgcttgcaatactggc
 D  A  I  V  N  P  A  G  P  N  A  C  A  D  R  A  C  N  T  G cacctcgccatgggctgggggtccggcaccaccgaattcccctacctaattgcgcccctc
 H  L  A  M  G  W  G  S  G  T  T  E  F  P  Y  L  I  A  P  L gacgccatccgccccgcgctgaagcagcaggcacgactctgaccctctccacaaccgac
 D  A  I  R  P  R  A  E  A  A  G  T  T  L  T  L  S  T  T  D gaccaagccagcgccgcctcagccgctgcggccgccgagacggccatcgtcttcatcacg
 D  Q  A  S  A  A  S  A  A  A  A  E  T  A  I  V  F  I  T gccgactcgggtgaggagtacctcaccgtcgagggcaatgcgggcgaccgcctcaacctc
 A  D  S  G  E  E  Y  L  T  V  E  G  N  A  G  D  R  L  N  L gacccgtggcacgacggcaacggcctcgtccgcgccgccgcctccgccggtaagcccgtc
 D  P  W  H  D  G  N  G  L  V  R  A  A  A  S  A  G  K  P  V attgtcgtcgcgcacagcgtcggcccatcatcctcgaggatattctcagccatgacaac
 I  V  V  A  H  S  V  G  P  I  I  L  E  D  I  L  S  H  D  N gtcgtcgccgtcgtctggggcggcattgccggccaggagagcggcaatggcctcgctgat
 V  V  A  V  V  W  G  G  I  A  G  Q  E  S  G  N  G  L  A  D gtgctgtatggcgacgtcagtccgagtgggaagctgccgtatacgattgctaaggcggcg
 V  L  Y  G  D  V  S  P  S  G  K  L  P  Y  T  I  A  K  A  A ggtgattatgggacacagctggagcctggtgacgacaacttcgaggagggcttgtatatc
 G  D  Y  G  T  Q  L  E  P  G  D  D  N  F  E  E  G  L  Y  I gattatcggcatttcgataaggcgggtatcgagccaagatatgagtttgggtttgggttg
 D  Y  R  H  F  D  K  A  G  I  E  P  R  Y  E  F  G  F  G  L tcgtacacgaacttcacctacaccgacctcgtcgccaccgccacgggcggcccttcctac
 S  Y  T  N  F  T  Y  T  D  L  V  A  T  A  T  G  G  P  S  Y ggcgcggcttccgcagcagcgacggacccctacgccccgctcgccaccgtcacggtgacc
 G  A  A  S  A  A  A  T  D  P  Y  A  P  L  A  T  V  T  V  T atcaccaacagcggcgacgtcgctggcgccgaggtcgcgcagctgtacctctcgctgccc
 I  T  N  S  G  D  V  A  G  A  E  V  A  Q  L  Y  L  S  L  P gcgtcggccggcgtcgacgccccgctgcgccagctgcgcggcttcgagaagctcgacctc
 A  S  A  G  V  D  A  P  L  R  Q  L  R  G  F  E  K  L  D  L gcgccgggcgagagtggcacggtcgagttcgtgctccgccgcaaggacgctagctactgg
 A  P  G  E  S  G  T  V  E  F  V  L  R  R  K  D  A  S  Y  W gatgtggcggcgcagcagtgggtgctgccggccggtgagttcgcgattgcggtgggtgca
 D  V  A  A  Q  Q  W  V  L  P  A  G  E  F  A  I  A  V  G  A agctcgagggatttgagattgcaggggtcgttgactgtttga
 S  S  R  D  L  R  L  Q  G  S  L  T  V  -
```

-continued

SEQ ID NO: 66
LENGTH: 733
TYPE: PRT
ORGANISM: M. phaseolina
MVNSYSLLLAIAAFGTATPVRRQAAGDWDAAYAQAEASLAQLNQDEKVGIVTGVGWQNGPCVGNTSPVPKIGY

PSLCLQDGPLGIRFAQGVTAFPAGVHAASTWDKSLIHERGVAMGAEAKGLGIHVQLGPVAGPLGKIPQGGRNW

EGFSPDPYLTGIAMHETITGMQSSGVQACAKHYIGNEQELNRNTMSSNIDDRTMHELYLWPFADAVKANVANF

MCSYNKLDGVWACENDHILNSLLKEELEFRGYVLSDWNAQHSTVLSANSGLDMTMPGDDFAGGSIYWGPNLTA

AIAAGQVPQSRLDDMVKRILAAWYLLGQDEGYPPTLFSSWNGGTGGPDVQADHKNVARAIARDGTILLKNDNA

TLPLKAPASLAIIGQDAIVNPAGPNACADRACNTGHLAMGWGSGTTEFPYLIAPLDAIRPRAEAAGTTLTLST

TDDQASAASAAAAAETAIVFITADSGEEYLTVEGNAGDRLNLDPWHDGNGLVRAAASAGKPVIVVAHSVGPII

LEDILSHDNVVAVVWGGIAGQESGNGLADVLYGDVSPSGKLPYTIAKAAGDYGTQLEPGDDNFEEGLYIDYRH

FDKAGIEPRYEFGFGLSYTNFTYTDLVATATGGPSYGAASAAATDPYAPLATVTVTITNSGDVAGAEVAQLYL

SLPASAGVDAPLRQLRGFEKLDLAPGESGTVEFVLRRKDASYWDVAAQQWVLPAGEFAIAVGASSRDLRLQGS

LTV*

SEQ ID NO: 67
LENGTH: 3114 (including 150 bp 5' UTR and 150 bp 3' UTR)
TYPE: DNA
ORGANISM: M. phaseolina
TCTGTTCATGCCACCGTGCTCTTAGCCATGTCTGTCTCCCTGCTTTGCGCAGCGTCTGCGCAGCCTCTCTTTC

TGTCTCTACTATCCGCTCCTTTATTTGCGAGAAGAGCGTCTGCTCAAGACTTGCCTAATGACCCCCGCTTTGA

ATTCATGTCCGCTGCTGCCGCGGACAATCAAACAACACCATCGACGAGACTAGCTGTGCCGGATGGATATGTT

GCTGCTCCCGCCTATCCTGCGCCTTATGGCGGCTGGGTTGAAGAATGGAGCGCCAGTTACGCTAAGGCCGCCG

AGCTCGTCTCCCAGATGACGCTCGCTGAAAAGACGAACATTACGTAAGTCACTATTCCCGGCCACGCTTCCGC

GGATTTCCAAACTGACGGAGAGTCCTGTTCAGCACTGGAACTGGGTACTTTATGGGTACGTTTAATTCTTAAA

TGCCCCCCAACGGCCGATTTGCTAATCCAACCCCGCACAGGCAGGTGTGTGGGCAACACTGGCAGCGCCCTTC

GTCTGGGCTTCCCGCAATTGTGTTTGCAGGACTCAGCCCTTGGGGTCAAGGGGACTGACAACGTCACCGCCTT

CCCTCCTGGTATCACCGTTGGTGCTACCTGGAACAAGGACTTGATGTATGCCCGCGGCGTAGCCATCGGCCAA

GAATTCCGCGGCAAGGGCGTGAACATCTACCTTGGTCCTACTGTCGGCCCCCTGGGACGCAAGCCTCGTGGAG

GCCGTAACTGGGAAGGCTTCGGGGCCGATCCCGTACTGCAAGCTGTTGGTGGCGCCTTGACTATCCAGGCCGT

GCAAGAGCAGGGTGTGATGGCCACCATCAAGCACTTCATTGGCAATGAGCAGGAGTCCTACCGCATGTAAGAA

ATGCACTCCCGCTATTATCCTCGAGCGCTGTTTTCCTGACTACCCCGCCAGGTACAACCCCTTCCAGCCCGGC

ATCAGCTCCAACATTGATGACCGGACCATGCACGAACTGTACCTGTGGCCCTTTGCGGAGGGCATCCGCGCAG

GCGTGACTTCCGTCATGACTGCTTACAACGCCGTAAGTCTTTCGTCGTCAATCAAGGCACCCCTCCTGACTCT

CGGCAGGTCAACGGCTCCGCATGCGCGCAAAACAGCTACAATATCAACCACCTCCTAAAGGACGAGCTCGGCT

TCCAGGGCTTCACCATGAGCGACTGGCTCTCCCAGATTTCGGGCGCGGCCTCCGCCCTCGCCGGCCTGGACAT

GACGATGCCGGGAGACCCCACGGTGCCCCTCTTCGGCGACGCATGGTGGGCGTTCCACCTGACCGAGGCGGCG

CTCAACGGCTCCGTGCCAATGGACCGCATCGACGACATGACGACGCGAATCGTGGCGGCCTGGTACCAGATGG

GCCAGGACCAGGAGTACCCGGACCCCAACTTCTCGACCTGGACGACGGACGCGACCGGCCTCCTTTACCCGGG

CGCCCTCTTCTCCCCCTCCGGCGTCGTCAACGAGTTCGTCAACGTGCAGGCCGACCACGCTGCGGTCGCGCGC

ACCGTCTCGATGGAAGCCGTCACCCTGCTCAAGAACGAGAACGGCACGCTGCCGCTCAGCGAGAGCACGCCGC

TCAAGGTCTTCGGCAGCGCGGCGGAAGAGAACCCGGATGGCATCAACTCGTGCTCGGACAAGTCGTGCAACAA

GGGCACGCTCGGCATGGGCTGGGGGTCCGGCACGGCCAACTACCCGTACATCGACTCGCCGATCGAAGCGCTG

ACGCGGCGCGCCCCAGAACGTCACCTCCTACCTGACCGACAGCTTCCCGTCGAATGCCGTGGTCGCTGACGGCG

ACGTCGCGCTCGTCTTCATCACGTCCGACTCGGGCGAGAACTACCTGAGCGTCGAGGGCAACCCGGGCGACCG

-continued

CACGGCGTCCGGGCTCAACGCGTGGCACAACGGTGATAAACTCGTCCAAGACGCCGCCGCTAAATACGACACG

GTTGTCGTGATCGTCCAGACCGTCGGCCCCATCCTGCTGGAGGAGTGGATCGACCTGCCGTCTGTCAAGGCCG

TCCTCTTCCAGCACCTCCCCGGCCAAGAGGCCGGCGAATCGCTCACCAGCGTCCTCTTCGGCGACGAGTCGCC

CAGCGGACACCTGCCGTACAGCATCCCGCGCGCCGAGGACGATCTCCCCGCGAGCGTCGGCATCGTGGGCTTT

GAGCTCGGGCAGCCGCAGGACACCTTCTCCGAAGGGCTGTACATCGACTACCGCTACCTGAACGCGCACAACA

CCACGCCGCGCTACCCCTTCGGCCACGGCCTCTCCTATACGACCTTCAACTACTCCGCGACCATCACGCCCGG

CATCGCCCTGACCAGCTCGCCTCCCGCGCGCCCCCCAAGGGCGCCACGCCGGCCTACAACACCACCATCCCC

GACCCCGCCGAGGCCGTCGGCCCGCCCGCCGGCTTCGACAAGATCTGGCGCTACATCTACTCGTGGCTGAGCG

AGTCCGACGCCGAGGCTGCCTATGCCAAGCGCAACACCACAACCTACCCCTACCCGGAAGGCTACAGCGAGAC

CCAGACGCCCGGCGTCCCCGCGGGCGGCGCGCAGGGCGGCAATCCGGCGCTGTGGGACACGGCCTTCAACGTT

ACCGCCACCATCACCAACACCGGCGTCGCCCCGGGCAAGGCCGTCGCGCAGGCGTACGTGCAGTTCCCGAGCG

GCATCGCGTGGGACACGCCCGTGATCCAGCTAAGGGATTTCGCCAAGACGGGGACGCTGCAGCCGGGCGAGAG

CGCCGAGGTGGTGTTGACGATTACGCGCAAGGATCTGAGCGTGTGGGATGTCGTGAGCCAGAACTGGGTTGTT

CCTGATGTGGAGGGCGAGTATAGGATTTGGGTTGGCGAGAGCTCGGGGACGTTGGAATTGGCGTGCTCGACGA

CGGGTTTGGAGTGTGAGAGCGGGCTGGAGAGTCCGGTTGCGTGATGAGGGATTGTGCGGAGAGCATTGATGAC

GATGTTAAGGGCGTTAATGTGGATGATGGGCTATATCTGCGAAAATCCTACCTCTTAGCGTTGGAACCCAACC

GGCCGTCCGAAGCCTTTTCCTCCGGGAATGTTCTTGGTCCTCTTGGTA

SEQ ID NO: 68
LENGTH: 2712
TYPE: DNA
ORGANISM: M. phaseolina
FEATURE NAME/KEY: CDS
LOCATION: (1)...(2712)

```
atgtctgtctccctgctttgcgcagcgtctgcgcagcctctctttctgtctctactatcc
 M  S  V  S  L  L  C  A  A  S  A  Q  P  L  F  L  S  L  L  S gctcctttatttgcgagaagagcgtctgctcaagacttgcctaatgaccccgctttgaa
 A  P  L  F  A  R  R  A  S  A  Q  D  L  P  N  D  P  R  F  E ttcatgtccgctgctgccgcggacaatcaaacaacaccatcgacgagactagctgtgccg
 F  M  S  A  A  A  A  D  N  Q  T  T  P  S  T  R  L  A  V  P gatggatatgttgctgctcccgcctatcctgcgccttatggcggctgggttgaagaatgg
 D  G  Y  V  A  A  P  A  Y  P  A  P  Y  G  G  W  V  E  E  W agcgccagttacgctaaggccgccgagctcgtctcccagatgacgctcgctgaaaagacg
 S  A  S  Y  A  K  A  A  E  L  V  S  Q  M  T  L  A  E  K  T aacattaccactggaactgggtactttatgggcaggtgtgtgggcaacactggcagcgcc
 N  I  T  T  G  T  G  Y  F  M  G  R  C  V  G  N  T  G  S  A cttcgtctgggcttcccgcaattgtgtttgcaggactcagcccttggggtcaaggggact
 L  R  L  G  F  P  Q  L  C  L  Q  D  S  A  L  G  V  K  G  T gacaacgtcaccgccttccctcctggtatcaccgttggtgctacctggaacaaggacttg
 D  N  V  T  A  F  P  P  G  I  T  V  G  A  T  W  N  K  D  L atgtatgcccgcggcgtagccatcggccaagaattccgcggcaagggcgtgaacatctac
 M  Y  A  R  G  V  A  I  G  Q  E  F  R  G  K  G  V  N  I  Y cttggtcctactgtcggcccctgggacgcaagcctcgtggaggccgtaactgggaaggc
 L  G  P  T  V  G  P  L  G  R  K  P  R  G  G  R  N  W  E  G ttcggggccgatcccgtactgcaagctgttggtggcgccttgactatccaggccgtgcaa
 F  G  A  D  P  V  L  Q  A  V  G  G  A  L  T  I  Q  A  V  Q gagcagggtgtgatggccaccatcaagcacttcattggcaatgagcaggagtcctaccgc
 E  Q  G  V  M  A  T  I  K  H  F  I  G  N  E  Q  E  S  Y  R atgtacaaccccttccagcccggcatcagctccaacattgatgaccggaccatgcacgaa
 M  Y  N  P  F  Q  P  G  I  S  S  N  I  D  D  R  T  M  H  E
```

-continued

```
ctgtacctgtggcccctttgcggagggcatccgcgcaggcgtgacttccgtcatgactgct
 L   Y   L   W   P   F   A   E   G   I   R   A   G   V   T   S   V   M   T   A tacaacgccgtcaacggctccgcatgcgcgcaaaacagctacaatatcaaccacctccta
 Y   N   A   V   N   G   S   A   C   A   Q   N   S   Y   N   I   N   H   L   L aaggacgagctcggcttccagggcttcaccatgagcgactggctctcccagatttcgggc
 K   D   E   L   G   F   Q   G   F   T   M   S   D   W   L   S   Q   I   S   G gcggcctccgccctcgccggcctggacatgacgatgccgggagaccccacggtgcccctc
 A   A   S   A   L   A   G   L   D   M   T   M   P   G   D   P   T   V   P   L ttcggcgacgcatggtgggcgttccacctgaccgaggcggcgctcaacggctccgtgcca
 F   G   D   A   W   W   A   F   H   L   T   E   A   A   L   N   G   S   V   P atggaccgcatcgacgacatgacgacgcgaatcgtggcggcctggtaccagatgggccag
 M   D   R   I   D   D   M   T   T   R   I   V   A   A   W   Y   Q   M   G   Q gaccaggagtacccggaccccaacttctcgacctggacgacggacgcgaccggcctcctt
 D   Q   E   Y   P   D   P   N   F   S   T   W   T   T   D   A   T   G   L   L tacccgggcgccctcttctctcccccctccggcgtcgtcaacgagttcgtcaacgtgcaggcc
 Y   P   G   A   L   F   S   P   S   G   V   V   N   E   F   V   N   V   Q   A gaccacgctgccgtcgcgcgcaccgtctcgatggaagccgtcaccctgctcaagaacgag
 D   H   A   A   V   A   R   T   V   S   M   E   A   V   T   L   L   K   N   E aacggcacgctgccgctcagcgagagcacgccgctcaaggtcttcggcagcgcggcggaa
 N   G   T   L   P   L   S   E   S   T   P   L   K   V   F   G   S   A   A   E gagaacccggatggcatcaactcgtgctcggacaagtcgtgcaacaagggcacgctcggc
 E   N   P   D   G   I   N   S   C   S   D   K   S   C   N   K   G   T   L   G atgggctggggtccggcacggccaactacccgtacatcgactcgccgatcgaagcgctg
 M   G   W   G   S   G   T   A   N   Y   P   Y   I   D   S   P   I   E   A   L acgcggcgcgcccagaacgtcacctcctacctgaccgacagcttcccgtcgaatgccgtg
 T   R   R   A   Q   N   V   T   S   Y   L   T   D   S   F   P   S   N   A   V gtcgctgacggcgacgtcgcgctcgtcttcatcacgtccgactcgggcgagaactacctg
 V   A   D   G   D   V   A   L   V   F   I   T   S   D   S   G   E   N   Y   L agcgtcgagggcaacccgggcgaccgcacggcgtccgggctcaacgcgtggcacaacggt
 S   V   E   G   N   P   G   D   R   T   A   S   G   L   N   A   W   H   N   G gataaactcgtccaagacgccgccgctaaatacgacacggttgtcgtgatcgtccagacc
 D   K   L   V   Q   D   A   A   A   K   Y   D   T   V   V   V   I   V   Q   T gtcggccccatcctgctggaggagtggatcgacctgccgtctgtcaaggccgtcctcttc
 V   G   P   I   L   L   E   E   W   I   D   L   P   S   V   K   A   V   L   F cagcacctccccggccaagaggccggcgaatcgctcaccagcgtcctcttcggcgacgag
 Q   H   L   P   G   Q   E   A   G   E   S   L   T   S   V   L   F   G   D   E tcgcccagcggacacctgccgtacagcatcccgcgcgccgaggacgatctccccgcgagc
 S   P   S   G   H   L   P   Y   S   I   P   R   A   E   D   D   L   P   A   S gtcggcatcgtgggctttgagctcgggcagccgcaggacaccttctccgaagggctgtac
 V   G   I   V   G   F   E   L   G   Q   P   Q   D   T   F   S   E   G   L   Y atcgactaccgctacctgaacgcgcacaacaccacgccgcgctaccccttcggccacggc
 I   D   Y   R   Y   L   N   A   H   N   T   T   P   R   Y   P   F   G   H   G ctctcctatacgaccttcaactactccgcgaccatcacgcccggcatcgccctgaccagc
 L   S   Y   T   T   F   N   Y   S   A   T   I   T   P   G   I   A   L   T   S tcgcctcccgcgcgccccccaagggcgccacgccggcctacaacaccaccatccccgac
 S   P   P   A   R   P   P   K   G   A   T   P   A   Y   N   T   T   I   P   D cccgccgaggccgtcggcccgcccgccggcttcgacaagatctggcgctacatctactcg
 P   A   E   A   V   G   P   P   A   G   F   D   K   I   W   R   Y   I   Y   S tggctgagcgagtccgacgccgaggctgcctatgccaagcgcaacaccacaacctacccc
 W   L   S   E   S   D   A   E   A   A   Y   A   K   R   N   T   T   T   Y   P tacccggaaggctacagcgagacccagacgcccggcgtccccgcgggcggcgcgcagggc
 Y   P   E   G   Y   S   E   T   Q   T   P   G   V   P   A   G   G   A   Q   G ggcaatccggcgctgtgggacacggccttcaacgttaccgccaccatcaccaacaccggc
 G   N   P   A   L   W   D   T   A   F   N   V   T   A   T   I   T   N   T   G
```

```
gtcgccccgggcaaggccgtcgcgcaggcgtacgtgcagttcccgagcggcatcgcgtgg
 V  A  P  G  K  A  V  A  Q  A  Y  V  Q  F  P  S  G  I  A  W gacacgcccgtgatccagctaaggggatttcgccaagacggggacgctgcagccgggcgag
 D  T  P  V  I  Q  L  R  D  F  A  K  T  G  T  L  Q  P  G  E agcgccgaggtggtgttgacgattacgcgcaaggatctgagcgtgtgggatgtcgtgagc
 S  A  E  V  V  L  T  I  T  R  K  D  L  S  V  W  D  V  V  S cagaactgggttgttcctgatgtggagggcgagtataggatttgggttggcgagagctcg
 Q  N  W  V  V  P  D  V  E  G  E  Y  R  I  W  V  G  E  S  S gggacgttggaattggcgtgctcgacgacgggtttggagtgtgagagcgggctggagagt
 G  T  L  E  L  A  C  S  T  T  G  L  E  C  E  S  G  L  E  S ccggttgcgtga
 P  V  A  -
```

SEQ ID NO: 69
LENGTH: 903
TYPE: PRT
ORGANISM: *M. phaseolina*
MSVSLLCAASAQPLFLSLLSAPLFARRASAQDLPNDPRFEFMSAAAADNQTTPSTRLAVPDGYVAAPAYPAPY

GGWVEEWSASYAKAAELVSQMTLAEKTNITTGTGYFMGRCVGNTGSALRLGFPQLCLQDSALGVKGTDNVTAF

PPGITVGATWNKDLMYARGVAIGQEFRGKGVNIYLGPTVGPLGRKPRGGRNWEGFGADPVLQAVGGALTIQAV

QEQGVMATIKHFIGNEQESYRMYNPFQPGISSNIDDRTMHELYLWPFAEGIRAGVTSVMTAYNAVNGSACAQN

SYNINHLLKDELGFQGFTMSDWLSQISGAASALAGLDMTMPGDPTVPLFGDAWWAFHLTEAALNGSVPMDRID

DMTTRIVAAWYQMGQDQEYPDPNFSTWTTDATGLLYPGALFSPSGVVNEFVNVQADHAAVARTVSMEAVTLLK

NENGTLPLSESTPLKVFGSAAEENPDGINSCSDKSCNKGTLGMGWGSGTANYPYIDSPIEALTRRAQNVTSYL

TDSFPSNAVVADGDVALVFITSDSGENYLSVEGNPGDRTASGLNAWHNGDKLVQDAAAKYDTVVVIVQTVGPI

LLEEWIDLPSVKAVLFQHLPGQEAGESLTSVLFGDESPSGHLPYSIPRAEDDLPASVGIVGFELGQPQDTFSE

GLYIDYRYLNAHNTTPRYPFGHGLSYTTFNYSATITPGIALTSSPPARPPKGATPAYNTTIPDPAEAVGPPAG

FDKIWRYIYSWLSESDAEAAYAKRNTTTYPYPEGYSETQTPGVPAGGAQGGNPALWDTAFNVTATITNTGVAP

GKAVAQAYVQFPSGIAWDTPVIQLRDFAKTGTLQPGESAEVVLTITRKDLSVWDVVSQNWVVPDVEGEYRIWV

GESSGTLELACSTTGLECESGLESPVA*

SEQ ID NO: 70
LENGTH: 3549 (including 150 bp 5' UTR and 150 bp 3' UTR)
TYPE: DNA
ORGANISM: *M. phaseolina*
GAAATTCCACATTTACCACTTCTCAGCTTCTCCCTCTCACTGCTCTCTCCCGCCCTTGCGCAGATGCCGAGCG

CCTCCTTGCCTCCTCACGCCGCCCACGCGTGAGACAGAAACCACCCAATTCCACTAATCGTAATACCTTGAAG

TACTATGCCCGACGACTACGAGCTCCGCGGCAAGTATTCCGCCGTCGACAGCCAGCCCCACCGCCGCAATGCT

TCCAGCAACAGCAACCTGCGCCCCTCGCTCGACGCCGCCTACCTCTCCTCCGACGACGACCAAGATCTTGACG

AGTTCGACCCGCTGAACGAGCAGAGCACCCCGCTCGACACCCACAAAGCTCGCCGCCGCCTCCGCTCCGAATC

CCAAGTCGGCGCCGGCGCCGACGCCTACACCCACGATCGATGGCGCAACCAGCACCGCCGGCCATGGGCGCGC

CTCGCCTCCACCTTCATGCCCGCCCGCAAACGCCTGTGGTGCTGGCTGCCCCTCCTCTTCATCCTCGCCCTCC

TCCTGCTCCTCGGTGCCGGCGGGCTGTGGGCCTGGCGATCCAGCCCGCTCGACGGCCAGAGCCCGCCGTGGTA

CCCGTCGCCGCGCGGTGGTGCGGACCCCAAATGGGCGGAGGCATACAGCCGGGCGGCGGCGCTGGTCGGCAAC

ATGACGCTGGTGGAGAAGGTCAACGTCACGACTGGCGTGGGCTGGTCGATGGGGCTCTGCGTGGGCAACACCG

GGCCGGTCCCGCGCCTGGGCTTTCCGAGTCTTTGCCTGCAGGATGGGCCGCTGGGCTTGCGCTTCGCTGACCA

CGCGACCGCGTGGCCCGCCGGCCTCACCGTCGGCGCCACCTGGAGCAAGGAGCTGATGTACCTGCGCGGTCAG

GCGCACGCGCGCGAGGCCAAGGGCAAAGGCGTCAACGTCCTGCTCGGTCCCGCAATGGGCCCGCTGGGCAGGC

TGCCCGCAGGCGGTCGCAATTGGGAAGGCTTCGGCGCGGACCCGGTGCTGCAGGGCCTCGCGGCCGCGTGGAC

GATCAAGGGGATTCAAGACGAGGGCGTTATGGCGACGGCGAAGCACTACGTCGGCAACGAGCAGGAGCATTTC

-continued

CGCCAGGCTTGGGAATGGGGCGCCCCCAACGCCATCTCCTCGAACATCGATGACCGTACGCTGCACGAGATCT
ACGCATGGCCATTCGCGGACAGCGTGCGCATCGGCGTTGCGAGCATCATGTGCTCTTACAACCAGGTCAACAA
CTCTTATGCCTGCCAGAACAGCAAGCTGCTCAATGGCGTGCTGAAGGACGAGCTCGGCTTCCAGGGATTCGTG
CAGTCGGACTGGCTGGCGCAGCGCAGCGGCGTTGCGAGCGCGCTAGCCGGGCTGGACATGAGTATGCCCGGGG
ATGGCCTCCGGTGGCAGGACGGCAAGTCGTTGTGGGGTCCGGAGCTGACCAGGGCCGCTTTGAACACCTCGGT
GCCCATGGAACGCCTGAATGATATGGCCACGCGGATCGTGGCCGCCTGGTACCAGCTTGGCCAGGACGATCCG
GAGAAGTGGCCGGAAAATGGGCCTAACTTTTCCTCCTGGACGGGCGAGAAGATCGGCTTGTTGCACCCTGGCA
GTGACGACCGGACTACGGGCGAGGTCAACAAGTTTGTCGACGTGCAGGGCAATGGCACGCATGGAAAGCTTGC
TCGCAGGATCGCCGCTGAGGGAATCGTGCTGGTCAAAAATGTGAACGATACGCTGCCTATTTCGCGTCAAGGC
CACAGCATTGTGAGCGGCTTCATCTCTAACAAGGATGACTTTAAAATGCACGTCGGTGTGTATGGCGAGGATG
CGCGCGGAAATCCGGAGGGCCCTAATGCCTGTGTCGACCGCGGGTGCAATGAAGGCACTCTGGCTTCTGGGTG
GGGGAGTGGCGCCGTCGAGTTCCCCTATCTCATCACTCCTCAGGAAGCTCTTAGGCGTGAGTTCGACAGCGAT
ATGGTGCTGCTGCACGAGTATCCTGCGAATGAGATCCCGGAGACGAAACAGCGTGCGCTTGAAGAGCAGGATC
TCTGCCTTGTGTTCGTCAACAGCGATGCTGGTGAAGGCTTCATTGCTTGGGAAGGTGTCAAGGGTGACAGGAA
TGATCTCTACACGCAGAAAGGCGGTGATAAGCTAGTTGAGACTGTCGCAAAACGATGCGGTGGCGGTGAGAGC
CCAGTCATTGTCGTTGTACATGCAGTTGGCCCCGTTATTCTCGAGAACTGGATTGATATCCCGAATGTCAAGT
CTGTTCTGCTCGCACACTTGCCCGGTCAGGAGAGCGGAAATGCGGTTGCAGACGTTATCTTTGGAGACACAAA
TCCCAGTGGCCGACTCCCGTACACAGTTGCGAAACATGCGGACGACTATGGCCCGGATAGCCATGTCATGTAC
TATCCCAATGGTGTCGTTCCGCAGCAGAACTTCACTGAAGGCCTGTATATCGACTACCGCTACTTCGATAAGA
ACGGAATCACCCCTCGGTACGAGTTTGGCTACGGCCTCTCTTACAGCAAGTTCGAGCTCTCACAACTCGAGAT
AACGGTTGATCCCACCAAGAAGACTCTCCTCCCAGCTCCGCGCCCTGACTCCAAGACTCTCCCTGCTCCTCCC
GATTTCGACAACACTGTTCCTCCAGCTAAGGAAGCACTCTTCCCCGATGGTTTCCGTCGTCTGAAGAAGTACA
TCTATCCGTACCTCACCAGCCTCTCCGGAACCGACCCAGCGCCCTACAAAGCGTATCCGGAAGCTTACACCAA

CAAAAAAAAGCATGAGAAGCCCTCGGAAGCCGGCGGCGGGCCCGGTGGTAACCCGGACTTGTATACGTATGTC

GCTAACGTGTCGTTCACCGTTAAAAACCTAAGTCCCGTCCGTGGCCAGGCGGTGCCGCAGCTGTATATCTCGT
ACCCAGAAAGCTGGACGGACCCGGATTTCCCGCTCGTATGGGGTCAGGGCTACACGAAAGAAGGCTCTTCGAC
TGACTCCGACAAGGACAATGACAAATTGAAGCAGCACTCCGAAGGCATCATCTCCGACAACGGCACTATTGCC
TCGCCTTTCTTGACTATCAACACCAGCAACCCTCATGCTAATGAGACGGAGCACGTCCGTCCGGATTGGTTCG
ACCCCCAGATGGTCGGGCAGCTCAGCGTCATCGATTTCCCCGTCCGCGTCCTGAGAGGCTGGGAGAAGGTCGA
CCTCGCGCCGGCGGGCGAGCCGGGCGATTTTGTGAGAGTGAGTATCGCGATTACGAGGAAGGATCTGAGCTAT
TGGGATGTTCGGCGGCAGAATTGGGTCATGCCCACGGTCGGGGGTGGCACGAGGGAGTTTGGGGTTTGGATTG
GGTGGAGCTCGAGGGACTTGGTTTTGAGTGGGATGATTTGAGGGGGCTGTATGTAGGAGGGCATCGAGAGAGG
TGGTGCATCTACTGGGAAGTGACTGTCTTGCATTTACTGGATCGGGGGGTGGCGTTCCTGTGGCGTAATTTCC
TTTTTTAGCTTTCCCCCTCACTTGCAAAGTGTCTGGTTTGCCCCC

SEQ ID NO: 71
LENGTH: 3249
TYPE: DNA
ORGANISM: *M. phaseolina*
FEATURE NAME/KEY: CDS
LOCATION: (1)...(3249)

atgcccgacgactacgagctccgcggcaagtattccgccgtcgacagccagccccaccgc
 M  P  D  D  Y  E  L  R  G  K  Y  S  A  V  D  S  Q  P  H  R cgcaatgcttccagcaacagcaacctgcgcccctcgctcgacgccgcctacctctcctcc
 R  N  A  S  S  N  S  N  L  R  P  S  L  D  A  A  Y  L  S  S

```
gacgacgaccaagatcttgacgagttcgaccgctgaacgagcagagcaccccgctcgac
 D   D   D   Q   L   D   E   F   D   P   L   N   E   Q   S   T   P   L   D acccacaaagctcgccgccgcctccgctccgaatcccaagtcggcgccggcgccgacgcc
 T   H   K   A   R   R   R   L   R   S   E   S   Q   V   G   A   G   A   D   A tacacccacgatcgatggcgcaaccagcaccgccggccatgggcgcgcctcgcctccacc
 Y   T   H   D   R   W   R   N   Q   H   R   R   P   W   A   R   L   A   S   T ttcatgcccgcccgcaaacgcctgtggtgctggctgcccctcctcttcatcctcgccctc
 F   M   P   A   R   K   R   L   W   C   W   L   P   L   L   F   I   L   A   L ctcctgctcctcggtgccggcgggctgtgggcctggcgatccagcccgctcgacggccag
 L   L   L   L   G   A   G   G   L   W   A   W   R   S   S   P   L   D   G   Q agcccgccgtggtaccgtcgccgcgcggtggtgcggaccccaaatgggcggaggcatac
 S   P   P   W   Y   P   S   P   R   G   G   A   D   P   K   W   A   E   A   Y agccgggcggcggcgctggtcggcaacatgacgctggtggagaaggtcaacgtcacgact
 S   R   A   A   A   L   V   G   N   M   T   L   V   E   K   V   N   V   T   T ggcgtgggctggtcgatggggctctgcgtgggcaacaccgggccggtcccgcgcctgggc
 G   V   G   W   S   M   G   L   C   V   G   N   T   G   P   V   P   R   L   G tttccgagtcttt gcctgcaggatgggccgctgggcttgcgcttcgctgaccacgcgacc
 F   P   S   L   C   L   Q   D   G   P   L   G   L   R   F   A   D   H   A   T gcgtggcccgccggcctcaccgtcggcgccacctggagcaaggagctgatgtacctgcgc
 A   W   P   A   G   L   T   V   G   A   T   W   S   K   E   L   M   Y   L   R ggtcaggcgcacgcgcgcgaggccaagggcaaaggcgtcaacgtcctgctcggtcccgca
 G   Q   A   H   A   R   E   A   K   G   K   G   V   N   V   L   L   G   P   A atgggcccgctgggcaggctgcccgcaggcggtcgcaattgggaaggcttcggcgcggac
 M   G   P   L   G   R   L   P   A   G   G   R   N   W   E   G   F   G   A   D ccggtgctgcagggcctcgcggccgcgtggacgatcaaggggattcaagacgagggcgtt
 P   V   L   Q   G   L   A   A   A   W   T   I   K   G   I   Q   D   E   G   V atggcgacggcgaagcactacgtcggcaacgagcaggagcatttccgccaggcttgggaa
 M   A   T   A   K   H   Y   V   G   N   E   Q   E   H   F   R   Q   A   W   E tggggcgccccaacgccatctcctcgaacatcgatgaccgtacgctgcacgagatctac
 W   G   A   P   N   A   I   S   S   N   I   D   D   R   T   L   H   E   I   Y gcatggccattcgcggacagcgtgcgcatcggcgttgcgagcatcatgtgctcttacaac
 A   W   P   F   A   D   S   V   R   I   G   V   A   S   I   M   C   S   Y   N caggtcaacaactcttatgcctgccagaacagcaagctgctcaatggcgtgctgaaggac
 Q   V   N   N   S   Y   A   C   Q   N   S   K   L   L   N   G   V   L   K   D gagctcggcttccagggattcgtgcagtcggactggctggcgcagcgcagcggcgttgcg
 E   L   G   F   Q   G   F   V   Q   S   D   W   L   A   Q   R   S   G   V   A agcgcgctagccgggctggacatgagtatgcccggggatggcctccggtggcaggacggc
 S   A   L   A   G   L   D   M   S   M   P   G   D   G   L   R   W   Q   D   G aagtcgttgtggggtccggagctgaccagggccgcttt gaacacctcggtgcccatggaa
 K   S   L   W   G   P   E   L   T   R   A   A   L   N   T   S   V   P   M   E cgcctgaatgatatggccacgcggatcgtggccgcctggtaccagcttggccaggacgat
 R   L   N   D   M   A   T   R   I   V   A   A   W   Y   Q   L   G   Q   D   D ccggagaagtggccggaaaatgggcctaacttttcctcctggacgggcgagaagatcggc
 P   E   K   W   P   E   N   G   P   N   F   S   S   W   T   G   E   K   I   G ttgttgcaccctggcagtgacgaccggactacgggcgaggtcaacaagtttgtcgacgtg
 L   L   H   P   G   S   D   D   R   T   T   G   E   V   N   K   F   V   D   V cagggcaatggcacgcatggaaagcttgctcgcaggatcgccgctgagggaatcgtgctg
 Q   G   N   G   T   H   G   K   L   A   R   R   I   A   A   E   G   I   V   L gtcaaaaatgtgaacgatacgctgcctattt cgcgtcaaggccacagcattgtgagcggc
 V   K   N   V   N   D   T   L   P   I   S   R   Q   G   H   S   I   V   S   G ttcatctctaacaaggatgactttaaaatgcacgtcggtgtgtatggcgaggatgcgcgc
 F   I   S   N   K   D   D   F   K   M   H   V   G   V   Y   G   E   D   A   R ggaaatccggagggccctaatgcctgtgtcgaccgcgggtgcaatgaaggcactctggct
 G   N   P   E   G   P   N   A   C   V   D   R   G   C   N   E   G   T   L   A
```

```
tctgggtggggagtggcgccgtcgagttcccctatctcatcactcctcaggaagctctt
 S  G  W  G  S  G  A  V  E  F  P  Y  L  I  T  P  Q  E  A  L aggcgtgagttcgacagcgatatggtgctgctgcacgagtatcctgcgaatgagatcccg
 R  R  E  F  D  S  D  M  V  L  L  H  E  Y  P  A  N  E  I  P gagacgaaacagcgtgcgcttgaagagcaggatctgccttgtgttcgtcaacagcgat
 E  T  K  Q  R  A  L  E  E  Q  D  L  C  L  V  F  V  N  S  D gctggtgaaggcttcattgcttgggaaggtgtcaagggtgacaggaatgatctctacacg
 A  G  E  G  F  I  A  W  E  G  V  K  G  D  R  N  D  L  Y  T cagaaaggcggtgataagctagttgagactgtcgcaaaacgatgcggtggcggtgagagc
 Q  K  G  G  D  K  L  V  E  T  V  A  K  R  C  G  G  G  E  S ccagtcattgtcgttgtacatgcagttggccccgttattctcgagaactggattgatatc
 P  V  I  V  V  V  H  A  V  G  P  V  I  L  E  N  W  I  D  I ccgaatgtcaagtctgttctgctcgcacacttgcccggtcaggagagcggaaatgcggtt
 P  N  V  K  S  V  L  L  A  H  L  P  G  Q  E  S  G  N  A  V gcagacgttatctttggagacacaaatcccagtggccgactcccgtacacagttgcgaaa
 A  D  V  I  F  G  D  T  N  P  S  G  R  L  P  Y  T  V  A  K catgcggacgactatggcccggatagccatgtcatgtactatcccaatggtgtcgttccg
 H  A  D  D  Y  G  P  D  S  H  V  M  Y  Y  P  N  G  V  V  P cagcagaacttcactgaaggcctgtatatcgactaccgctacttcgataagaacggaatc
 Q  Q  N  F  T  E  G  L  Y  I  D  Y  R  Y  F  D  K  N  G  I accctcggtacgagtttggctacggcctctcttacagcaagttcgagctctcacaactc
 T  P  R  Y  E  F  G  Y  G  L  S  Y  S  K  F  E  L  S  Q  L gagataacggttgatcccaccaagaagactctcctcccagctccgcgccctgactccaag
 E  I  T  V  D  P  T  K  K  T  L  L  P  A  P  R  P  D  S  K actctccctgctcctcccgatttcgacaacactgttcctccagctaaggaagcactcttc
 T  L  P  A  P  P  D  F  D  N  T  V  P  P  A  K  E  A  L  F cccgatggtttccgtcgtctgaagaagtacatctatccgtacctcaccagcctctccgga
 P  D  G  F  R  R  L  K  K  Y  I  Y  P  Y  L  T  S  L  S  G accgacccagcgccctacaaagcgtatccggaagcttacaccaacaaaaaaaagcatgag
 T  D  P  A  P  Y  K  A  Y  P  E  A  Y  T  N  K  K  K  H  E aagccctcggaagccggcggcgggccggtggtaacccggacttgtatacgtatgtcgct
 K  P  S  E  A  G  G  G  P  G  G  N  P  D  L  Y  T  Y  V  A aacgtgtcgttcaccgttaaaaacctaagtcccgtccgtggccaggcggtgccgcagctg
 N  V  S  F  T  V  K  N  L  S  P  V  R  G  Q  A  V  P  Q  L tatatctcgtacccagaaagctggacggacccggatttcccgctcgtatggggtcagggc
 Y  I  S  Y  P  E  S  W  T  D  P  D  F  P  L  V  W  G  Q  G tacacgaaagaaggctcttcgactgactccgacaaggacaatgacaaattgaagcagcac
 Y  T  K  E  G  S  S  T  D  S  D  K  D  N  D  K  L  K  Q  H tccgaaggcatcatctccgacaacggcactattgcctcgcctttcttgactatcaacacc
 S  E  G  I  I  S  D  N  G  T  I  A  S  P  F  L  T  I  N  T agcaaccctcatgctaatgagacggagcacgtccgtccggattggttcgaccccagatg
 S  N  P  H  A  N  E  T  E  H  V  R  P  D  W  F  D  P  Q  M gtcgggcagctcagcgtcatcgatttccccgtccgcgtcctgagaggctgggagaaggtc
 V  G  Q  L  S  V  I  D  F  P  V  R  V  L  R  G  W  E  K  V gacctcgcgccggcgggcgagccgggcgattttgtgagagtgagtatcgcgattacgagg
 D  L  A  P  A  G  E  P  G  D  F  V  R  V  S  I  A  I  T  R aaggatctgagctattgggatgttcggcggcagaattgggtcatgcccacggtcggggt
 K  D  L  S  Y  W  D  V  R  R  Q  N  W  V  M  P  T  V  G  G ggcacgagggagtttggggtttggattgggtggagctcgagggacttggttttgagtggg
 G  T  R  E  F  G  V  W  I  G  W  S  S  R  D  L  V  L  S  G atgatttga
 M  I  -
```

-continued

SEQ ID NO: 72
LENGTH: 1082
TYPE: PRT
ORGANISM: M. phaseolina
MPDDYELRGKYSAVDSQPHRRNASSNSNLRPSLDAAYLSSDDDQDLDEFDPLNEQSTPLDTHKARRRLRSESQ

VGAGADAYTHDRWRNQHRRPWARLASTFMPARKRLWCWLPLLFILALLLLLGAGGLWAWRSSPLDGQSPPWYP

SPRGGADPKWAEAYSRAAALVGNMTLVEKVNVTTGVGWSMGLCVGNTGPVPRLGFPSLCLQDGPLGLRFADHA

TAWPAGLTVGATWSKELMYLRGQAHAREAKGKGVNVLLGPAMGPLGRLPAGGRNWEGFGADPVLQGLAAAWTI

KGIQDEGVMATAKHYVGNEQEHFRQAWEWGAPNAISSNIDDRTLHEIYAWPFADSVRIGVASIMCSYNQVNNS

YACQNSKLLNGVLKDELGFQGFVQSDWLAQRSGVASALAGLDMSMPGDGLRWQDGKSLWGPELTRAALNTSVP

MERLNDMATRIVAAWYQLGQDDPEKWPENGPNFSSWTGEKIGLLHPGSDDRTTGEVNKFVDVQGNGTHGKLAR

RIAAEGIVLVKNVNDTLPISRQGHSIVSGFISNKDDFKMHVGVYGEDARGNPEGPNACVDRGCNEGTLASGWG

SGAVEFPYLITPQEALRREFDSDMVLLHEYPANEIPETKQRALEEQDLCLVFVNSDAGEGFIAWEGVKGDRND

LYTQKGGDKLVETVAKRCGGGESPVIVVVHAVGPVILENWIDIPNVKSVLLAHLPGQESGNAVADVIFGDTNP

SGRLPYTVAKHADDYGPDSHVMYYPNGVVPQQNFTEGLYIDYRYFDKNGITPRYEFGYGLSYSKFELSQLEIT

VDPTKKTLLPAPRPDSKTLPAPPDFDNTVPPAKEALFPDGFRRLKKYIYPYLTSLSGTDPAPYKAYPEAYTNK

KKHEKPSEAGGGPGGNPDLYTYVANVSFTVKNLSPVRGQAVPQLYISYPESWTDPDFPLVWGQGYTKEGSSTD

SDKDNDKLKQHSEGIISDNGTIASPFLTINTSNPHANETEHVRPDWFDPQMVGQLSVIDFPVRVLRGWEKVDL

APAGEPGDFVRVSIAITRKDLSYWDVRRQNWVMPTVGGGTREFGVWIGWSSRDLVLSGMI*

SEQ ID NO: 73
LENGTH: 3411 (including 150 bp 5' UTR and 150 bp 3' UTR)
TYPE: DNA
ORGANISM: M. phaseolina
TGCCTGCATGGATTCCCCGCTGGCCGCAGAGCTACCCTGGCCGCTGCTGAAGTCATTGACTTGCCTGGCAATC

CTTATAAATATTTCCCTGCTCCGCCGCCCTCCCAGTTTCCCCAGCCAGGAGCCGCTTCTCTCGTCGTTGCCGT

CAACATGCGCTTCACCACGGCCACTGCTGCTCTTGCCGCCGCGCCACTTGTGGCTTCCCAGGTACGCGTTCCT

GCTGTTTGCTCCCGTCCGCACCGACCACCGCACCCACGACACCACGCTCTCTCTCCCCCGTCCAACTCCACTC

TCCCTTTCCAACCATGCACCACCATGTCCCTCCAATCCCGTGGGGCCATTCGACCGCGTCGAAGCTCCTCCGC

CCTCCAAACGCTCGCGTCCTCCTGCAATCGTGCATTGTGACGGAAGCTTTCCGCCCTGTCTTTCCGAGCGCTC

CACGCAGTCAAAGACGCCACTACGACTCGTCTGCCGGCGCCGGCGCTTCGTTCCCGTCACGTCCCTTGCAATT

GTTTCTGCAAAGTTCCCCcGCAAGCACCTGCTCGCGCTCGAGCCAGCGCCTTGCCCACACTGGCCATCGCTAA

ACTGTCCATAGGCCCTCAACGACTCCAGCCCCGACGACGCTCTCTGGGGTGCCACCTCCCCGCCATACTACCC

TTCGCCATGGGCCGAGGGCACTGGCGAGTGGGCCCATGCCCACGCCAAGGCTCAGGAATTCGTCAAGCAGATG

ACCCTGCTTGAGAAGGTCAACCTGACCACGGGTGTTGGGTATGCAACTACCTCCTTGCCCCCATTTCTGCGAG

CTCTGCTGATCCATTGACAGTTGGGAGGGCGGCCCATGTGTTGGCAATGTTGGTTCCGTGCCGCGCCTTGGCC

TGCACTCGCTGTGCATGCAGGACTCGCCCACTGGTATCCGCTTCGGTATGCCAGCCCCTCCCCGGTAACATCT

ATCAGCTTCCTAACCATGCAACAGCCGACTACAACTCCGCCTTCACCTCGGGCGGAACCGTCGCCGCATCTTT

TGACCGCCGTCTCTGGTACCAGCGCGGCCACGACATGGGCTCCGAATTTGCCGGCAAGGGCATTGACGTGCTC

CTTGGGCCCGTCGTTGGTCCCCTGGGGCGCACTCCCACAGGCGGCCGCAACTGGGAGGGTTTCAGCCCCGACC

CGGCCCTCTCTGGTATCGCTGTTGCCGAGACCATCAAGGGTATCCAGGACGCCGGTGTTATTGCCTGCACCAA

GCACTACATCGTCAACGAGCAGGAGCACTTCCGCCAGGCGCCGGAGGCCAAGGGGTTTGGAGTCAACATCACC

GAGTCTCTGAGTTCCAACGTCGACGACGTCACCCTGCACGAGCTTTACCTCTGGCCCTTCGCCGACGCGGTCA

AGGCCGGAACTGGCGCCATCATGTGCTCTTACAACCAGATCAACAACAGCTACGGCTGCCAGAACTCCCACCT

GCTCAACTACATCCTCAAGGGTGAGCTCGGCTTCCAGGGTTTCGTCATGAGCGATTGGCAGGCTCAGCACTCT

GGTGTTGGCTCCGCTTTGGCTGGTATGGACATGGCCATGCCTGGTGACACCGTCTTCAGCACCGGCGACGCCT

```
TCTGGGCGCCAACCTGACGCTTGCTGTCATCAACGGCACCGTTCCCGAGTGGCGCATTGACGATGCCGCCAC

CCGTATCCTGTCTGCCTACTTCTTCGCCAACCGCGACAAGAACTACCGCCCGACCAACTTCAACTCCTGGACC

CTGGACACCTATGGCTATGCTAACGCCGGCGGTGAGGCCAACTATGGCCTTGTCAACCAGCACGTCAACGTCC

GTGCCAACCACGCTAAGAACATCCGCGATGCTGCTGCCAAGTCCACCGTCCTCCTCAAGAACGTCGACGGCAC

TCTCCCTCTTACCGGCAAGGAGAAGTTCATTGGTGTCTTCGGCAGTGATGCTGGCGACTCCCTGTCTGGCCCC

AACGGCTGCGATGACCGCGGATGCACCAACGGTACCCTCGCTATGGGTTGGGGGTCCGGAACTGCCAACTTCC

CTTACCTCGTCTCGCCGCTTACTGCCATCTCTAACGAGGTTATTGAGAACAACGGCGTCATTGACTGGGTCAC

CGATGACTGGAACTACGACAGGATCTTCGCTCTTGCTGCGCAGGTCAGCCACGCCATCGTCTTTGTCAACTCC

GACAGCGGCGAGGGTTACATCAACTTCGACGGCAACATTGGTGACCGCAACAACCTCACCCTCTGGCACGACG

GTGAGGCCCTGATCCGCAATGTTACCTCTGTCAACAACAACACCATCGTCGTCATCCACAGCGTCGGCCCCGT

CGAGCTTGGTGCCTTCAACGACAACCCCAACGTGACTGCCCTGATCTGGGCCGGTCTCCCTGGCGAGCAGTCT

GGTAATGCTCTTGCCGACATCCTTTACGCCGCGTCAACCCTGGTGCCAAGCTTCCCTTCACGTTCGGCGCCA

AGCGTGAGGACTATGGCACCGAGCTCCTGTACGAGCCCAACAATGGGGAGAACGCTCCCCAGGACAACTTCAA

GGAGGGTGTCTTCATCGACTACCGTGGCTTCGACAAGCGCAACGTGACCCCCATCTACGAGTTCGGTTTCGGT

CTGTCCTACACTACCTTCTCCTACTCGGACATCAAGGTCGTCAAGCACACCGTCGCCGACTACACGCCCAACA

CCGGCAACACTTCCGCCGCACCCATCCTGGGCAACTTCAGCACCGACCTCGCCGACTACCAGTTCCCGCCCGA

GATCACTCCCGTCTCCGGCTACATCTACCCCTATCTCAACTCGACCGATGCCGCCGAGGCCAACAACGACTCT

GAGGTCGAGTACGGCCTCCCCAACGACTCCTACATCCCCGAGGGCGCCCTCGACGGCTCCCCGCAGCCCAAGA

TCGCTGCTGGTGGTGCGCCCGGCGGTAACCCCGCTCTTTACGACGTCCTCTTCACCGTCACCGCCACCGTCAC

CAACACGGGCGACGTTGAGGGTGACGAGGTGCCCCAGCTGTACGTCTCGCTCGGCGGCCCCAATGACCCCGTC

GTCCAGCTCCGCGGCTTCGAGCGCTACACCATCGCTCCGGGCGCCACCGCCACCTTTGGCGTCGATGTCACCA

GGAGGGACCTGAGCAACTGGGACACCGTCAGCCAGAACTGGGTCATTACTGAATACCCCAAGACGGTGTATGT

GGGTAGCTCGTCGAGGAACTTGCCTCTGTCAGCGGAATTGGATATCTGAAGGACTTCAATGGACGGGAAGAA

GTAGTTAATCGCTTGATTCTACATAATGACGTATTGGGGATGTAATGAAATAATGATTTTGGACGCTACACTG

TTCTCCCTGCATGTGTGAATGCTTCGGATGAAACTCCTGTGAAACTATGTCAT

SEQ ID NO: 74
LENGTH: 2616
TYPE: DNA
ORGANISM: M. phaseolina
FEATURE NAME/KEY: CDS
LOCATION: (1)...(2616)
atgcgcttcaccacggccactgctgctcttgccgccgcgccacttgtggcttcccaggcc
 M   R   F   T   T   A   T   A   A   L   A   A   A   P   L   V   A   S   Q   A ctcaacgactccagccccgacgacgctctctggggtgccacctccccgccatactaccct
 L   N   D   S   S   P   D   D   A   L   W   G   A   T   S   P   P   Y   Y   P tcgccatgggccgagggcactggcgagtgggcccatgcccacgccaaggctcaggaattc
 S   P   W   A   E   G   T   G   E   W   A   H   A   H   A   K   A   Q   E   F gtcaagcagatgaccctgcttgagaaggtcaacctgaccacgggtgttggttgggagggc
 V   K   Q   M   T   L   L   E   K   V   N   L   T   T   G   V   G   W   E   G ggcccatgtgttggcaatgttggttccgtgccgcgccttggcctgcactcgctgtgcatg
 G   P   C   V   G   N   V   G   S   V   P   R   L   G   L   H   S   L   C   M caggactcgccactggtatccgcttcgccgactacaactccgccttcacctcgggcgga
 Q   D   S   P   T   G   I   R   F   A   D   Y   N   S   A   F   T   S   G   G accgtcgccgcatctttgaccgccgtctctggtaccagcgcggccacgacatgggctcc
 T   V   A   A   S   F   D   R   R   L   W   Y   Q   R   G   H   D   M   G   S gaatttgccggcaagggcattgacgtgctccttgggcccgtcgttggtcccctggggcgc
 E   F   A   G   K   G   I   D   V   L   L   G   P   V   V   G   P   L   G   R
```

```
actcccacaggcggccgcaactgggaggggtttcagccccgaccggccctctctggtatc
 T  P  T  G  G  R  N  W  E  G  F  S  P  D  P  A  L  S  G  I gctgttgccgagaccatcaagggtatccaggacgccggtgttattgcctgcaccaagcac
 A  V  A  E  T  I  K  G  I  Q  D  A  G  V  I  A  C  T  K  H tacatcgtcaacgagcaggagcacttccgccaggcgccggaggccaaggggtttggagtc
 Y  I  V  N  E  Q  E  H  F  R  Q  A  P  E  A  K  G  F  G  V aacatcaccgagtctctgagttccaacgtcgacgacgtcaccctgcacgagctttacctc
 N  I  T  E  S  L  S  S  N  V  D  D  V  T  L  H  E  L  Y  L tggcccttcgccgacgcggtcaaggccggaactggcgccatcatgtgctcttacaaccag
 W  P  F  A  D  A  V  K  A  G  T  G  A  I  M  C  S  Y  N  Q atcaacaacagctacggctgccagaactcccacctgctcaactacatcctcaagggtgag
 I  N  N  S  Y  G  C  Q  N  S  H  L  L  N  Y  I  L  K  G  E ctcggcttccagggtttcgtcatgagcgattggcaggctcagcactctggtgttggctcc
 L  G  F  Q  G  F  V  M  S  D  W  Q  A  Q  H  S  G  V  G  S gctttggctggtatggacatggccatgcctggtgacaccgtcttcagcaccggcgacgcc
 A  L  A  G  M  D  M  A  M  P  G  D  T  V  F  S  T  G  D  A ttctggggcgccaacctgacgcttgctgtcatcaacggcaccgttccgagtggcgcatt
 F  W  G  A  N  L  T  L  A  V  I  N  G  T  V  P  E  W  R  I gacgatgccgccacccgtatcctgtctgcctacttcttcgccaaccgcgacaagaactac
 D  D  A  A  T  R  I  L  S  A  Y  F  F  A  N  R  D  K  N  Y cgcccgaccaacttcaactcctggaccctggacacctatggctatgctaacgccggcggt
 R  P  T  N  F  N  S  W  T  L  D  T  Y  G  Y  A  N  A  G  G gaggccaactatggccttgtcaaccagcacgtcaacgtccgtgccaaccacgctaagaac
 E  A  N  Y  G  L  V  N  Q  H  V  N  V  R  A  N  H  A  K  N atccgcgatgctgctgccaagtccaccgtcctcctcaagaacgtcgacggcactctccct
 I  R  D  A  A  A  K  S  T  V  L  L  K  N  V  D  G  T  L  P cttaccggcaaggagaagttcattggtgtcttcggcagtgatgctggcgactccctgtct
 L  T  G  K  E  K  F  I  G  V  F  G  S  D  A  G  D  S  L  S ggccccaacggctgcgatgaccgcggatgcaccaacggtaccctcgctatgggttggggg
 G  P  N  G  C  D  D  R  G  C  T  N  G  T  L  A  M  G  W  G tccggaactgccaacttcccttacctcgtctcgccgcttactgccatctctaacgaggtt
 S  G  T  A  N  F  P  Y  L  V  S  P  L  T  A  I  S  N  E  V attgagaacaacggcgtcattgactgggtcaccgatgactggaactacgacaggatcttc
 I  E  N  N  G  V  I  D  W  V  T  D  D  W  N  Y  D  R  I  F gctcttgctgcgcaggtcagccacgccatcgtctttgtcaactccgacagcggcgagggt
 A  L  A  A  Q  V  S  H  A  I  V  F  V  N  S  D  S  G  E  G tacatcaacttcgacggcaacattggtgaccgcaacaacctcaccctctggcacgacggt
 Y  I  N  F  D  G  N  I  G  D  R  N  N  L  T  L  W  H  D  G gaggccctgatccgcaatgttacctctgtcaacaacaacaccatcgtcgtcatccacagc
 E  A  L  I  R  N  V  T  S  V  N  N  N  T  I  V  V  I  H  S gtcggcccgtcgagcttggtgccttcaacgacaaccccaacgtgactgccctgatctgg
 V  G  P  V  E  L  G  A  F  N  D  N  P  N  V  T  A  L  I  W gccggtctccctggcgagcagtctggtaatgctcttgccgacatcctttacggccgcgtc
 A  G  L  P  G  E  Q  S  G  N  A  L  A  D  I  L  Y  G  R  V aaccctggtgccaagcttcccttcacgttcggcgccaagcgtgaggactatggcaccgag
 N  P  G  A  K  L  P  F  T  F  G  A  K  R  E  D  Y  G  T  E ctcctgtacgagcccaacaatggggagaacgctcccaggacaacttcaaggagggtgtc
 L  L  Y  E  P  N  N  G  E  N  A  P  Q  D  N  F  K  E  G  V ttcatcgactaccgtggcttcgacaagcgcaacgtgaccccatctacgagttcggtttc
 F  I  D  Y  R  G  F  D  K  R  N  V  T  P  I  Y  E  F  G  F ggtctgtcctacactaccttctcctactcggacatcaaggtcgtcaagcacaccgtcgcc
 G  L  S  Y  T  T  F  S  Y  S  D  I  K  V  V  K  H  T  V  A gactacacgcccaacaccggcaacacttccgccgcacccatcctgggcaacttcagcacc
 D  Y  T  P  N  T  G  N  T  S  A  A  P  I  L  G  N  F  S  T
```

-continued

```
gacctcgccgactaccagttcccgcccgagatcactcccgtctccggctacatctacccc
 D   L   A   D   Y   Q   F   P   P   E   I   T   P   V   S   G   Y   I   Y   P tatctcaactcgaccgatgccgccgaggccaacaacgactctgaggtcgagtacggcctc
 Y   L   N   S   T   D   A   A   E   A   N   N   D   S   E   V   E   Y   G   L cccaacgactcctacatccccgagggcgccctcgacggctccccgcagcccaagatcgct
 P   N   D   S   Y   I   P   E   G   A   L   D   G   S   P   Q   P   K   I   A gctggtggtgcgcccggcggtaacccccgctctttacgacgtcctcttcaccgtcaccgcc
 A   G   G   A   P   G   G   N   P   A   L   Y   D   V   L   F   T   V   T   A accgtcaccaacacgggcgacgttgagggtgacgaggtgccccagctgtacgtctcgctc
 T   V   T   N   T   G   D   V   E   G   D   E   V   P   Q   L   Y   V   S   L ggcggccccaatgacccgtcgtccagctccgcggcttcgagcgctacaccatcgctccg
 G   G   P   N   D   P   V   V   Q   L   R   G   F   E   R   Y   T   I   A   P ggcgccaccgccacctttggcgtcgatgtcaccaggagggacctgagcaactgggacacc
 G   A   T   A   T   F   G   V   D   V   T   R   R   D   L   S   N   W   D   T gtcagccagaactgggtcattactgaataccccaagacggtgtatgtgggtagctcgtcg
 V   S   Q   N   W   V   I   T   E   Y   P   K   T   V   Y   V   G   S   S   S aggaacttgcctctgtcagcggaattggatatctga
 R   N   L   P   L   S   A   E   L   D   I   -
```

SEQ ID NO: 75
LENGTH: 871
TYPE: PRT
ORGANISM: M. phaseolina
MRFTTATAALAAAPLVASQALNDSSPDDALWGATSPPYYPSPWAEGTGEWAHAHAKAQEFVKQMTLLEKVNLT

TGVGWEGGPCVGNVGSVPRLGLHSLCMQDSPTGIRFADYNSAFTSGGTVAASFDRRLWYQRGHDMGSEFAGKG

IDVLLGPVVGPLGRTPTGGRNWEGFSPDPALSGIAVAETIKGIQDAGVIACTKHYIVNEQEHFRQAPEAKGFG

VNITESLSSNVDDVTLHELYLWPFADAVKAGTGAIMCSYNQINNSYGCQNSHLLNYILKGELGFQGFVMSDWQ

AQHSGVGSALAGMDMAMPGDTVFSTGDAFWGANLTLAVINGTVPEWRIDDAATRILSAYFFANRDKNYRPTNF

NSWTLDTYGYANAGGEANYGLVNQHVNVRANHAKNIRDAAAKSTVLLKNVDGTLPLTGKEKFIGVFGSDAGDS

LSGPNGCDDRGCTNGTLAMGWGSGTANFPYLVSPLTAISNEVIENNGVIDWVTDDWNYDRIFALAAQVSHAIV

FVNSDSGEGYINFDGNIGDRNNLTLWHDGEALIRNVTSVNNNTIVVIHSVGPVELGAFNDNPNVTALIWAGLP

GEQSGNALADILYGRVNPGAKLPFTFGAKREDYGTELLYEPNNGENAPQDNFKEGVFIDYRGFDKRNVTPIYE

FGFGLSYTTFSYSDIKVVKHTVADYTPNTGNTSAAPILGNFSTDLADYQFPPEITPVSGYIYPYLNSTDAAEA

NNDSEVEYGLPNDSYIPEGALDGSPQPKIAAGGAPGGNPALYDVLFTVTATVTNTGDVEGDEVPQLYVSLGGP

NDPVVQLRGFERYTIAPGATATFGVDVTRRDLSNWDTVSQNWVITEYPKTVYVGSSSRNLPLSAELDI*

SEQ ID NO: 76
LENGTH: 2818 (including 150 bp 5' UTR and 150 bp 3' UTR)
TYPE: DNA
ORGANISM: M. phaseolina
GCCGCCGCGTCGCTCTGGTTAGCCACCATGTTGGATCATCGTATGAATAGCGAGCTCTTCTCCCGTACATAGC

CTGATCTTCCACTCCTCAGTCTGTCTCGCTTATTCGACAGCCATTCTTTACTTCGTGACCGCGTTTCTTTTCC

GAACATGAGAGCTTTCACCGCTTTCGGTGTTGCTTCAACGCTCGTTTCGAGCAGCTACGCCGCTTCCAATTCG

TCCGCTTCCGCCTCCATCCTGTCTTCCGGTAAAGGCAAGTTTTGTTCCATGAATGCTCCAGCTATTTTGTTCA

GCACCCTCATACCTACTGCGCACAGTGCAGCTTGGCAACTTCGAAGCGGCATACGAGAAAGCCAAAGCCCTGG

TTGCCGGTCTGAGCAACACCGAAAAAATTTCCATCATCACCGGCGGCGATGCTACTGGCACCAACGTTACCTG

GACCGCCCTTGAGAACAAGGATGGCGCCAGCGGCATCAACTACCAGTACTATGTCTCCGGATTCAGCATGGAC

AACGCCCTGGCCATGACCTGGGATAGGGACTACTTCGAGCAGCAGAACAAGGCCCTCGGCCGCGAGTTCTATC

TGACCGGCTACAATCTCATCAACGGCCCCGAATGTGGTCCCCTTGGCCGAACGCCTTGGGGTGGTCGCCAGGC

TGAGGCCTACAGCCCTGACCGTGAGTGCCTCCGAGGAAAGTAAACCGACAACCGCGGGCTAACATGGCTCCCA

GCCTACCTCTCCGGTGCCGTCATGTCCAAGGCTATCGCTGCAATGAACGCCGCGGGTGTCGTCGCCGGCGGCA
```

-continued

```
GGCATTTCCTCCTGAACGAACAGGAGACGAACCGTTCCTCCAGCATCTCGGCCACCACGACCAGCGTCTATAC

GTCCAATGCCGATGATAAGACGATCCACGAGCTCTACCTCTGGCCCTTCCAGGAGGGTGTCAAGGCTGGCATG

GCCGCTGTCATGTGCGCCATGACTCGTGTTAACGGTACCCTCTCCTGCGAGAACAGTGACTTGGTGTCCGGCC

TTCTCAAGTCCGAGCTCGGCTTCCCCGGCATGGTCTTCCCAGATGTCAACTCGCAGGCGACATCGTACGGGTC

GGCGAACGCCGGCCTCGACTACGGCTCAAGCTCTTACTGGACTTCAGACATCCTCGAAGCGGGTATTGCCAAC

GGCTCTTTCACTCAGGCCCGCCTGGATGATATGGCTGTCCGCAACCTGATCGGCTATTTCTATGTCGGGCTGG

ACGATGGCAAGCAGCCCGAGGTGGCCAGCACGACCGAGTACCGCGACGTGCGTGCCAACCACTCGGCCCTGAT

CCGCGAGATTGGCGCCGCCTCGCTCGTCCTACTCAAGAACAACAACACCGTCGCCGGCCAGGGTCTACCCCTG

AACCGCCCTCGCACCATCAGCGTCTTCGGCGCCCACGCTGGTCCCGCCCTGGCTGGACCCAACCAGGCTTTCT

CTGTCCAGGGTACCGACGGCCCGACGTACGACGGTCACCTCGCGTCCGGGAGTGGCAGTGGTGCCCTATCCTT

CTCCTACCTCATCACTCCCTTCCAGAGTCTTAGCACCCGCGCCGCTGCCGACGGCAGCATGATCCGCTGGATC

CTCAACGATACCTATTCCTCCTCGAGCAGCGGCGGCATGGGCGGCGGTATGGGCGGTAGTCACGGCGGTTTTC

CGACCATGAGCGGCAACTCGAGCTCTAGCGGCAACGGCACCGACGGCGGCATGGGTGGCGGCGCTGCGGCAGG

CGGTGCTGGCGGCGGCATCAGCATCAGCGGCCAGGGCACCGCCGTCACCCCGAGTATCGAGGCCTACGCCGAG

GACAGCGAGGTATGCCTCGTCTTCCTCAACTCTTTCTCGGGCGAGGGCGGCGACCGCGAGGAGCTCTACAACG

CCGACCAGGACACGCTCGTCTCCACGGTCGCCTCCAGCTGCAACAACACCATCGTCGTCATCAATACCGTCGG

CCCGCGCCTGGTCGACGCGTGGATCGAGAACGAGAATGTCACCTCGGTCCTCTACGGCGGCCTGCTCGGCCAG

GAGTCCGGCAACGCCATCGCCGACGTGCTGTACGGCGACGTCAACCCGTCGGGCAAACTGATCAACACGATCG

CCAAGAACGAGACCGACTACCCCGTCTCCATCTGCTACACCGAGGTCTGCGACTTCTCCGAGGGCATCTACAT

CGATTACCGCCACTTCGACAAGTTCAACGTGACCCCGCGCTACCCCTTCGGCCACGGCCTGTCCTACACAACC

TTCGCATTCGGCGCCGTCGCCGCGCAGAAGACCGACGAATCCGCGCTCGCCTCGGCGTACCCGACCGGCCCGC

TCGCCGTCGGCGGCAAGACGGATCTCTTCGACGAGGTCATCGCCGTCACCACGTCCGTCACCAACACTGGTGA

CGTCGACGGCGCAGAGGTCGCCCAGCTGTACGTCGCCTACCCGGCCGCCGCCGACCAGCCCGTGCGCCAGCTG

CGCGGCTTCGAGAAGGTCAAGCTGGCCAAGGGCGAGAAGAAGGAGGTCACTTTCAGCGTCCGCAGGAAGGACG

TCTCCTACTGGGACACCGCCGCCCAGGAGTGGGCCATCGCCCCCGGCACGTACACCTTCTCCGTCGGCGCCAG

CTCGCGCGACCTAAAGGGCGAGGCCACCGTCACAATCTGAGTGGAGCTGTAAATGAGCGGTATAGAACTCCCG

GGGTTGGTGGCGCGACGTCTGTAGATACACGGTTTAAGGTGGCATTTTTATGTGTGTATTTTTGTAGTCTTCT

CCATGTGAATGTATATATTCAGTCGTATATTTGCGGTAAAGATT
```

SEQ ID NO: 77
LENGTH: 2418
TYPE: DNA
ORGANISM: M. phaseolina
FEATURE NAME/KEY: CDS
LOCATION: (1)...(2418)

```
atgagagcttccaccgctttcggtgttgcttcaacgctcgtttcgagcagctacgccgct
 M   R   A   F   T   A   F   G   V   A   S   T   L   V   S   S   Y   A   A tccaattcgtccgcttccgcctccatcctgtcttccgcaccctcatacctactgcgcaca
 S   N   S   S   A   S   A   S   I   L   S   S   A   P   S   Y   L   L   R   T gtgcagcttggcaacttcgaagcggcatacgagaaagccaaagccctggttgccggtctg
 V   Q   L   G   N   F   E   A   A   Y   E   K   A   K   A   L   V   A   G   L
agcaacaccgaaaaaatttccatcatcaccggcggcgatgctactggcaccaacgttacc
 S   N   T   E   K   I   S   I   I   T   G   G   D   A   T   G   T   N   V   T tggaccgcccttgagaacaaggatggcgccagcggcatcaactaccagtactatgtctcc
 W   T   A   L   E   N   K   D   G   A   S   G   I   N   Y   Q   Y   Y   V   S ggattcagcatggacaacgccctggccatgacctgggatagggactacttcgagcagcag
 G   F   S   M   D   N   A   L   A   M   T   W   D   R   D   Y   F   E   Q   Q aacaaggcccctcggccgcgagttctatctgaccggctacaatctcatcaacggccccgaa
 N   K   A   L   G   R   E   F   Y   L   T   G   Y   N   L   I   N   G   P   E
```

-continued

```
tgtggtcccttggccgaacgccttggggtggtcgccaggctgaggcctacagccctgac
 C  G  P  L  G  R  T  P  W  G  G  R  Q  A  E  A  Y  S  P  D ccctacctctccggtgccgtcatgtccaaggctatcgctgcaatgaacgccgcgggtgtc
 P  Y  L  S  G  A  V  M  S  K  A  I  A  A  M  N  A  A  G  V gtcgccggcggcaggcatttcctcctgaacgaacaggagacgaaccgttcctccagcatc
 V  A  G  G  R  H  F  L  L  N  E  Q  E  T  N  R  S  S  S  I tcggccaccacgaccagcgtctatacgtccaatgccgatgataagacgatccacgagctc
 S  A  T  T  T  S  V  Y  T  S  N  A  D  D  K  T  I  H  E  L tacctctggcccttccaggagggtgtcaaggctggcatggccgctgtcatgtgcgccatg
 Y  L  W  P  F  Q  E  G  V  K  A  G  M  A  A  V  M  C  A  M actcgtgttaacggtaccctctcctgcgagaacagtgacttggtgtccggccttctcaag
 T  R  V  N  G  T  L  S  C  E  N  S  D  L  V  S  G  L  L  K tccgagctcggcttccccggcatggtcttcccagatgtcaactcgcaggcgacatcgtac
 S  E  L  G  F  P  G  M  V  F  P  D  V  N  S  Q  A  T  S  Y gggtcggcgaacgccggcctcgactacggctcaagctcttactggacttcagacatcctc
 G  S  A  N  A  G  L  D  Y  G  S  S  S  Y  W  T  S  D  I  L gaagcgggtattgccaacggctctttcactcaggcccgcctggatgatatggctgtccgc
 E  A  G  I  A  N  G  S  F  T  Q  A  R  L  D  D  M  A  V  R aacctgatcggctatttctatgtcggggctggacgatggcaagcagcccgaggtggccagc
 N  L  I  G  Y  F  Y  V  G  L  D  D  G  K  Q  P  E  V  A  S acgaccgagtaccgcgacgtgcgtgccaaccactcggccctgatccgcgagattggcgcc
 T  T  E  Y  R  D  V  R  A  N  H  S  A  L  I  R  E  I  G  A gcctcgctcgtcctactcaagaacaacaacaccgtcgccggccagggtctacccctgaac
 A  S  L  V  L  L  K  N  N  N  T  V  A  G  Q  G  L  P  L  N cgccctcgcaccatcagcgtcttcggcgcccacgctggtcccgccctggctggacccaac
 R  P  R  T  I  S  V  F  G  A  H  A  G  P  A  L  A  G  P  N caggctttctctgtccagggtaccgacggcccgacgtacgacggtcacctcgcgtccggg
 Q  A  F  S  V  Q  G  T  D  G  P  T  Y  D  G  H  L  A  S  G agtggcagtggtgccctatccttctcctacctcatcactcccttccagagtcttagcacc
 S  G  S  G  A  L  S  F  S  Y  L  I  T  P  F  Q  S  L  S  T cgcgccgctgccgacggcagcatgatccgctggatcctcaacgatacctattcctcctcg
 R  A  A  A  D  G  S  M  I  R  W  I  L  N  D  T  Y  S  S  S agcagcggcggcatgggcggcggtatgggcggtagtcacggcggttttccgaccatgagc
 S  S  G  G  M  G  G  G  M  G  G  S  H  G  G  F  P  T  M  S ggcaactcgagctctagcggcaacggcaccgacggcggcatgggtggcggcgctgcggca
 G  N  S  S  S  G  N  G  T  D  G  G  M  G  G  G  A  A  A ggcggtgctggcggcggcatcagcatcagcggccagggcaccgccgtcaccccgagtatc
 G  G  A  G  G  G  I  S  I  S  G  Q  G  T  A  V  T  P  S  I gaggcctacgccgaggacagcgaggtatgcctcgtcttcctcaactctttctcgggcgag
 E  A  Y  A  E  D  S  E  V  C  L  V  F  L  N  S  F  S  G  E ggcggcgaccgcgaggagctctacaacgccgaccaggacacgctcgtctccacggtcgcc
 G  G  D  R  E  E  L  Y  N  A  D  Q  D  T  L  V  S  T  V  A tccagctgcaacaacaccatcgtcgtcatcaataccgtcggcccgcgcctggtcgacgcg
 S  S  C  N  N  T  I  V  V  I  N  T  V  G  P  R  L  V  D  A tggatcgagaacgagaatgtcacctcggtcctctacggcggcctgctcggccaggagtcc
 W  I  E  N  E  N  V  T  S  V  L  Y  G  G  L  L  G  Q  E  S ggcaacgccatcgccgacgtgctgtacggcgacgtcaacccgtcgggcaaactgatcaac
 G  N  A  I  A  D  V  L  Y  G  D  V  N  P  S  G  K  L  I  N acgatcgccaagaacgagaccgactaccccgtctccatctgctacaccgaggtctgcgac
 T  I  A  K  N  E  T  D  Y  P  V  S  I  C  Y  T  E  V  C  D ttctccgagggcatctacatcgattaccgccacttcgacaagttcaacgtgaccccgcgc
 F  S  E  G  I  Y  I  D  Y  R  H  F  D  K  F  N  V  T  P  R tacccccttcggccacggcctgtcctacacaaccttcgcattcggcgccgtcgccgcgcag
 Y  P  F  G  H  G  L  S  Y  T  T  F  A  F  G  A  V  A  A  Q
```

```
aagaccgacgaatccgcgctcgcctcggcgtacccgaccggcccgctcgccgtcggcggc
 K  T  D  E  S  A  L  A  S  A  Y  P  T  G  P  L  A  V  G  G aagacggatctcttcgacgaggtcatcgccgtcaccacgtccgtcaccaacactggtgac
 K  T  D  L  F  D  E  V  I  A  V  T  T  S  V  T  N  T  G  D gtcgacggcgcagaggtcgcccagctgtacgtcgcctacccggccgccgccgaccagccc
 V  D  G  A  E  V  A  Q  L  Y  V  A  Y  P  A  A  A  D  Q  P gtgcgccagctgcgcggcttcgagaaggtcaagctggccaagggcgagaagaaggaggtc
 V  R  Q  L  R  G  F  E  K  V  K  L  A  K  G  E  K  K  E  V actttcagcgtccgcaggaaggacgtctcctactgggacaccgccgcccaggagtgggcc
 T  F  S  V  R  R  K  D  V  S  Y  W  D  T  A  A  Q  E  W  A atcgccccggcacgtacaccttctccgtcggcgccagctcgcgcgacctaaagggcgag
 I  A  P  G  T  Y  T  F  S  V  G  A  S  S  R  D  L  K  G  E gccaccgtcacaatctga
 A  T  V  T  I  -

SEQ ID NO: 78
LENGTH: 805
TYPE: PRT
ORGANISM: M. phaseolina
MRAFTAFGVASTLVSSSYAASNSSASASILSSAPSYLLRTVQLGNFEAAYEKAKALVAGLSNTEKISIITGGD

ATGTNVTWTALENKDGASGINYQYYVSGFSMDNALAMTWDRDYFEQQNKALGREFYLTGYNLINGPECGPLGR

TPWGGRQAEAYSPDPYLSGAVMSKAIAAMNAAGVVAGGRHFLLNEQETNRSSSISATTTSVYTSNADDKTIHE

LYLWPFQEGVKAGMAAVMCAMTRVNGTLSCENSDLVSGLLKSELGFPGMVFPDVNSQATSYGSANAGLDYGSS

SYWTSDILEAGIANGSFTQARLDDMAVRNLIGYFYVGLDDGKQPEVASTTEYRDVRANHSALIREIGAASLVL

LKNNNTVAGQGLPLNRPRTISVFGAHAGPALAGPNQAFSVQGTDGPTYDGHLASGSGSGALSFSYLITPFQSL

STRAAADGSMIRWILNDTYSSSSSGGMGGGMGGSHGGFPTMSGNSSSSGNGTDGGMGGGAAAGGAGGGISISG

QGTAVTPSIEAYAEDSEVCLVFLNSFSGEGGDREELYNADQDTLVSTVASSCNNTIVVINTVGPRLVDAWIEN

ENVTSVLYGGLLGQESGNAIADVLYGDVNPSGKLINTIAKNETDYPVSICYTEVCDFSEGIYIDYRHFDKFNV

TPRYPFGHGLSYTTFAFGAVAAQKTDESALASAYPTGPLAVGGKTDLFDEVIAVTTSVTNTGDVDGAEVAQLY

VAYPAAADQPVRQLRGFEKVKLAKGEKKEVTFSVRRKDVSYWDTAAQEWAIAPGTYTFSVGASSRDLKGEATV

TI*

SEQ ID NO: 79
LENGTH: 2990 (including 150 by 5' UTR and 150 by 3' UTR)
TYPE: DNA
ORGANISM: M. phaseolina
GGACGTCATTCATTTAAAGAGGGACCGGGAGACACATTTCCTTAAATTCGCGTTCTGTCGTGTCTTGAGACAA

GAACCCGCAGTTCTTCCCCTTTTTCTTCATTCTCGAAAGAGACGTCGATTTTTCTTGCTATCGACGTTGCCAG

AACAATGGTCTCGAGCTCGGCGAGTGCTTATTTGACGGCCGTCGCCGTTGTGGCTGCCGCCGCTGGCGTCGCC

AATGGCCAGGCCGTCACCAACGGCACCGCGCCACTGTACAAGAACCCGTCCGCTCCGGTCGAGGACCGTGTCC

AGGATCTGCTCTCGCGCATGACCCTCCAGGAAAAGGTGGCGCAGCTGATTCAGGGCGACATCACCAATTTCAT

TAATCAGACTACTGGCGAGTTCAATGCCAGCGGTCTGGCGTGGAATATGGAGTGGAGGGCTGGCCAGATCTGG

ACTGGCTATCCCATTCCTCAGGTCAGCTTCCGTCGTGAAAACAGATGTCTTTTGTGTGTGTCTCTGATTTTGG

AGTAGCGTTGGATCGCGGACGCGGGTAAGACTGCGCAGGACTACCTGCTGCACAACACCACTCTTGGCATCCC

GGCGTTGGTAAGATCATGCCCGAAGCTTGAGCTGAGCCACGTGGCTAATGAAAACGCAACAGCTGCAAAATGA

GGGTATTCACGGAGGTGAGGTCTATCACTACATCGAAACGCCCACAAAGCTCACAGCTTCCCAGTGGCTTACT

TCAACGCGACCATCTTCAACAGCCCCATCGCCCACGCCTGCTCGTTCAATCCGGACCTCATCGGCGAGATGGG

CGCCGTCATCGCGCAGGAGGCTCTCGCCCTCGGCATCAACCAGATCTTCGCTCCCGTCGTCGACCTCGCGCGC

GAGTTGCGCTTCGGCAGAGTTGAGGAAACTTACGGCGAGGACCCGTACCTGGCTGGCGAAATGGGTTACGCAT

ACGTTCGCGCTCTGGAGAGCCAGAATGTCAGCGCCATGGTCAAGCACTTTGCTGGGTTCAGCAACCCCGAGCA
```

-continued

```
GGGCCTCAACACTGGGCCTGTGCATGGCGGAGAGCGTGAGTTGAGGACGACTTGGCTGCCACCTTTCCACCGT
GCTATCATTGATGGCGGTGCTACGTCGATAATGTCGGCTTACCACTCTTGGGATGGTGTGCCGGCAGTTGCTG
ACTATCACACCCTCACTGAGGTAAGCTATTCGGGAGTTTCAGGGTGGACACGGTTTTCCTGGCCGTGCCCCCG
AGGAGTCTTCCCAAATTGCCCTGGAAATGCGTGAGTGAGGCCAAAAAGCTGACGACCATCAATAGATTCTCCG
TGAAGAATGGGGATACGAATACTACGTTAGCTCCGATGCTGGCGGAACAGATCGCCTTTGCAACGCTTTCAAG
ATGTGCCGCTCCAACCCAATTGACAAGGAAGCTGTCACAATGTACGCCCTGCCCGCCGGAAACGATGTTGAGA
TGGGAGGAGGCTCCTACAACTTCGAGACCATCATCGACCTTATCGGCTCCGGTAAGCTGGACATCGACATCGT
GGACACTGCCGTTGCCAGAACTCTCCGGACCAAGTTCTTCCTCGGCCTGTTCGAGGACCCCTACCGTGCCGTC
CCCGCCAACGAGACCGCCCTCCACATTCACACTGCCAAGTCTGTCGACCTTGCACGTAAGCTGGACGCCGAGT
CCATTGTCCTGCTCGAGAACCATGACAACGTCCTGCCGCTCGACAAGTCTGCCAACATCGCCGTCATCGGCCC
CATGGCAGACTTCATGAACGTGAGCTAGCAACCCAACCAAAAAAAAAAAAAAATCCCATATTCTCACTAACAG
CACCTCTCCAGTACGGCGACTATGTCGTCCAAGACTCGCAATACCGCGGCGTCACGCCCTACGCTGGCATCGC
CGCCGCGTCGACCGGCACCGTGACCTACACCCTCGGCACAGAGCGCTGGTCGACCGACACGTCGGGCTTCCCA
GCCGCTATCGCCGCCGCGCAAGCCGCGGACGTCGCCGTCGTCGTCGTCGGCACGTGGTCGCGCGACCAGACGC
AGCTGTGGCAGGGTCTCAACGCGACGACGGGCGAGCACGTGGACGTGCATGACCTGGCGCTCGTCGGCGCGCA
GGCGGCGCTGGTCAAGGCCATCATCGCGACTGGCAAGCCCACCGTCGTCGTCTTCCAGTCGGGCAAGCCCGTC
ACCGAGCCATGGATCTCGCGCAACGCCTCCGCCCTCGTCCAGCAGTTCTACCCGGGCGAGCAAGGCGGCAACG
CCCTCGCCGACGTGCTGTTCGGCGACCACAATCCCAGCGGCAAGCTGGCCGTCGGCTTCCCGTACGACGTCGG
CACGACGCCCGTCTTCTACGACTACCTCAACTCCGGCCGCACCGTCGACGCCGGGCAGGTGTTCGACAATGGG
ACCCTGCTGTTCGGGCACCAGTACGTCCTCTCCTCGCCGCTGCCGCTGTACGAGTTCGGGTACGGCAAGAGCT
ACGCCGAGTTTGCGTACTCGAACGTGACGCTGTCCAAGGCTACCGCCAGTGCGACGGATGTTGTCACGGCCAC
GGTGAGCGTGACGAACAACTCGACGAGGGATGGCCAGGAGGTCGTGCAGCTGTACGTCAGCGACTTGATTGCC
AGCGTGGCTGTGCCGAACAAGGAGTTGAAGGGGTTTAAGAAGGTTTTTATCCCGGCAGGCGAGACGGTCGATG
TCGCGATTGATATTGATGTGAGTAAATTGGGCGTGTGGGATATCAGGATGAAGTATGTGGTCGAGCCGGGCGA
GTTCGCGATTTGGGTCGGTAGCTCGAGTGCGGATTTGAGGGGGAATGCGACGCTGACGGTAGAGTAAAGGGGA
GGGGGGAGGAAACGAATGGATCGGTGGGAGTGGTGGGTTGCGGATTCGATTCTGTTGTATATATTTGTAAATA
CTGTTTGAGGATGTTCACATGGTGGGCAGCTGGTTGCAATCCTGCAAATAAGATTCGGCTTATGTAGTTG
```

SEQ ID NO: 80
LENGTH: 2346
TYPE: DNA
ORGANISM: M. phaseolina
FEATURE NAME/KEY: CDS
LOCATION: (1)...(2346)

```
atggtctcgagctcggcgagtgcttatttgacggccgtcgccgttgtggctgccgccgct
 M  V  S  S  S  A  S  A  Y  L  T  A  V  A  V  V  A  A  A  A ggcgtcgccaatggccaggccgtcaccaacggcaccgcgccactgtacaagaacccgtcc
 G  V  A  N  G  Q  A  V  T  N  G  T  A  P  L  Y  K  N  P  S gctccggtcgaggaccgtgtccaggatctgctctcgcgcatgaccctccaggaaaaggtg
 A  P  V  E  D  R  V  Q  D  L  L  S  R  M  T  L  Q  E  K  V gcgcagctgattcagggcgacatcaccaatttcattaatcagactactggcgagttcaat
 A  Q  L  I  Q  G  D  I  T  N  F  I  N  Q  T  T  G  E  F  N gccagcggtctggcgtggaatatggagtggagggctggccagatctggactggctatccc
 A  S  G  L  A  W  N  M  E  W  R  A  G  Q  I  W  T  G  Y  P attcctcagcgttggatcgcggacgcggggtaagactgcgcaggactacctgctgcacaac
 I  P  Q  R  W  I  A  D  A  G  K  T  A  Q  D  Y  L  L  H  N accactcttggcatcccggcgttgctgcaaaatgagggtattcacggagtggcttacttc
 T  T  L  G  I  P  A  L  L  Q  N  E  G  I  H  G  V  A  Y  F
```

-continued

```
aacgcgaccatcttcaacagcccatcgcccacgcctgctcgttcaatccggacctcatc
 N  A  T  I  F  N  S  P  I  A  H  A  C  S  F  N  P  D  L  I ggcgagatgggcgccgtcatcgcgcaggaggctctcgccctcggcatcaaccagatcttc
 G  E  M  G  A  V  I  A  Q  E  A  L  A  L  G  I  N  Q  I  F gctcccgtcgtcgacctcgcgcgcgagttgcgcttcggcagagttgaggaaacttacggc
 A  P  V  V  D  L  A  R  E  L  R  F  G  R  V  E  E  T  Y  G gaggacccgtacctggctggcgaaatgggttacgcatacgttcgcgctctggagagccag
 E  D  P  Y  L  A  G  E  M  G  Y  A  Y  V  R  A  L  E  S  Q aatgtcagcgccatggtcaagcactttgctgggttcagcaaccccgagcagggcctcaac
 N  V  S  A  M  V  K  H  F  A  G  F  S  N  P  E  Q  G  L  N actgggcctgtgcatggcggagagcgtgagttgaggacgacttggctgccacctttccac
 T  G  P  V  H  G  G  E  R  E  L  R  T  T  W  L  P  P  F  H cgtgctatcattgatggcggtgctacgtcgataatgtcggcttaccactcttgggatggt
 R  A  I  I  D  G  G  A  T  S  I  M  S  A  Y  H  S  W  D  G gtgccggcagttgctgactatcacaccctcactgagattctccgtgaagaatggggatac
 V  P  A  V  A  D  Y  H  T  L  T  E  I  L  R  E  E  W  G  Y gaatactacgttagctccgatgctggcggaacagatcgccttttgcaacgctttcaagatg
 E  Y  Y  V  S  S  D  A  G  G  T  D  R  L  C  N  A  F  K  M tgccgctccaacccaattgacaaggaagctgtcacaatgtacgcctgcccgccggaaac
 C  R  S  N  P  I  D  K  E  A  V  T  M  Y  A  L  P  A  G  N gatgttgagatgggaggaggctcctacaacttcgagaccatcatcgaccttatcggctcc
 D  V  E  M  G  G  G  S  Y  N  F  E  T  I  I  D  L  I  G  S ggtaagctggacatcgacatcgtggacactgccgttgccagaactctccggaccaagttc
 G  K  L  D  I  D  I  V  D  T  A  V  A  R  T  L  R  T  K  F ttcctcggcctgttcgaggacccctaccgtgccgtccccgccaacgagaccgccctccac
 F  L  G  L  F  E  D  P  Y  R  A  V  P  A  N  E  T  A  L  H attcacactgccaagtctgtcgaccttgcacgtaagctggacgccgagtccattgtcctg
 I  H  T  A  K  S  V  D  L  A  R  K  L  D  A  E  S  I  V  L ctcgagaaccatgacaacgtcctgccgctcgacaagtctgccaacatcgccgtcatcggc
 L  E  N  H  D  N  V  L  P  L  D  K  S  A  N  I  A  V  I  G cccatggcagacttcatgaactacggcgactatgtcgtccaagactcgcaataccgcggc
 P  M  A  D  F  M  N  Y  G  D  Y  V  V  Q  D  S  Q  Y  R  G gtcacgccctacgctggcatcgccgccgcgtcgaccggcaccgtgacctacaccctcggc
 V  T  P  Y  A  G  I  A  A  A  S  T  G  T  V  T  Y  T  L  G acagagcgctggtcgaccgacacgtcgggcttcccagccgctatcgccgccgcgcaagcc
 T  E  R  W  S  T  D  T  S  G  F  P  A  A  I  A  A  A  Q  A gcggacgtcgccgtcgtcgtcgtcggcacgtggtcgcgcgaccagacgcagctgtggcag
 A  D  V  A  V  V  V  V  G  T  W  S  R  D  Q  T  Q  L  W  Q ggtctcaacgcgacgacgggcgagcacgtggacgtgcatgacctggcgctcgtcggcgcg
 G  L  N  A  T  T  G  E  H  V  D  V  H  D  L  A  L  V  G  A caggcggcgctggtcaaggccatcatcgcgactggcaagcccaccgtcgtcgtcttccag
 Q  A  A  L  V  K  A  I  I  A  T  G  K  P  T  V  V  V  F  Q tcgggcaagcccgtcaccgagccatggatctcgcgcaacgcctccgccctcgtccagcag
 S  G  K  P  V  T  E  P  W  I  S  R  N  A  S  A  L  V  Q  Q ttctacccgggcgagcaaggcggcaacgccctcgccgacgtgctgttcggcgaccacaat
 F  Y  P  G  E  Q  G  G  N  A  L  A  D  V  L  F  G  D  H  N cccagcggcaagctggccgtcggcttcccgtacgacgtcggcacgacgcccgtcttctac
 P  S  G  K  L  A  V  G  F  P  Y  D  V  G  T  T  P  V  F  Y gactacctcaactccggccgcaccgtcgacgccgggcaggtgttcgacaatgggaccctg
 D  Y  L  N  S  G  R  T  V  D  A  G  Q  V  F  D  N  G  T  L ctgttcgggcaccagtacgtcctctcctcgccgctgccgctgtacgagttcgggtacggc
 L  F  G  H  Q  Y  V  L  S  S  P  L  P  L  Y  E  F  G  Y  G aagagctacgccgagtttgcgtactcgaacgtgacgctgtccaaggctaccgccagtgcg
 K  S  Y  A  E  F  A  Y  S  N  V  T  L  S  K  A  T  A  S  A
```

```
                                             -continued
acggatgttgtcacggccacggtgagcgtgacgaacaactcgacgagggatggccaggag
 T  D  V  V  T  A  T  V  S  V  T  N  N  S  T  R  D  G  Q  E gtcgtgcagctgtacgtcagcgacttgattgccagcgtggctgtgccgaacaaggagttg
 V  V  Q  L  Y  V  S  D  L  I  A  S  V  A  V  P  N  K  E  L aaggggtttaagaaggttttatcccggcaggcgagacggtcgatgtcgcgattgatatt
 K  G  F  K  K  V  F  I  P  A  G  E  T  V  D  V  A  I  D  I gatgtgagtaaattgggcgtgtgggatatcaggatgaagtatgtggtcgagccgggcgag
 D  V  S  K  L  G  V  W  D  I  R  M  K  Y  V  V  E  P  G  E
ttcgcgatttgggtcggtagctcgagtgcggatttgaggggaatgcgacgctgacggta
 F  A  I  W  V  G  S  S  A  D  L  R  G  N  A  T  L  T  V gagtaa
 E  -
```

SEQ ID NO: 81
LENGTH: 781
TYPE: PRT
ORGANISM: M. phaseolina

MVSSSASAYLTAVAVVAAAAGVANGQAVTNGTAPLYKNPSAPVEDRVQDLLSRMTLQEKVAQLIQGDITNFIN

QTTGEFNASGLAWNMEWRAGQIWTGYPIPQRWIADAGKTAQDYLLHNTTLGIPALLQNEGIHGVAYFNATIFN

SPIAHACSFNPDLIGEMGAVIAQEALALGINQIFAPVVDLARELRFGRVEETYGEDPYLAGEMGYAYVRALES

QNVSAMVKHFAGFSNPEQGLNTGPVHGGERELRTTWLPPFHRAIIDGGATSIMSAYHSWDGVPAVADYHTLTE

ILREEWGYEYYVSSDAGGTDRLCNAFKMCRSNPIDKEAVTMYALPAGNDVEMGGGSYNFETIIDLIGSGKLDI

DIVDTAVARTLRTKFFLGLFEDPYRAVPANETALHIHTAKSVDLARKLDAESIVLLENHDNVLPLDKSANIAV

IGPMADFMNYGDYVVQDSQYRGVTPYAGIAAASTGTVTYTLGTERWSTDTSGFPAAIAAAQAADVAVVVGTW

SRDQTQLWQGLNATTGEHVDVHDLALVGAQAALVKAIIATGKPTVVVFQSGKPVTEPWISRNASALVQQFYPG

EQGGNALADVLFGDHNPSGKLAVGFPYDVGTTPVFYDYLNSGRTVDAGQVFDNGTLLFGHQYVLSSPLPLYEF

GYGKSYAEFAYSNVTLSKATASATDVVTATVSVTNNSTRDGQEVVQLYVSDLIASVAVPNKELKGFKKVFIPA

GETVDVAIDIDVSKLGVWDIRMKYVVEPGEFAIWVGSSSADLRGNATLTVE*

SEQ ID NO: 82
LENGTH: 2954 (including 150 bp 5' UTR and 150 bp 3' UTR)
TYPE: DNA
ORGANISM: M. phaseolina

CTGGACGGCTCTGCGGAAGTACAAAGATGCAGCCTTCCGCTCTCCCAGCCGGAGAGTGGCATCAGCCTTCTGC

TGCCGTTCCACCTCGTCTGCCCTTTTTTCCGGCTCGCCGTGCGGGGTAGGGTTTGTGGTACTCCATCGTCTTC

CGTTATGGCGCCCATAGATGTCGAAGATGCGCTTTCGAAGCTGGAGCTGAACGAGAAAGTCGAGCTGCTCTCT

GGTAAGGGCCCGCCCCGCCAAGTGAGTATCCTCGTCATTTACAGCGGCGCAGGCATCGATTTCTGGCACACCAA

GCCCATCCCTCGTCTTGGAATCCCATCCATACGCACATCCGACGGCCCCAATGGCGTTCGTGGCACCCGCTTC

TTCAACGGCGTCCCCGCTGCCTGCTTTCCCTGCGGTACCGGACTGGCAGCCACCTGGGATGTCGACCTCATCC

GCGACGGAGGCAAGCTGATGGGCAAGGAGGCAATCGCGAAAGGCGCCCATGTCATTCTTGGCCCGACCACCAA

CATGCAGCGCGCCCGCTTGGTAGACGGGGGTTCGAAAGCTTCAGCGAAGATCCGTTCCTTGCTGGTGCAATG

AGTGCCGCTACTGTGGACGGGATCCAGTCAACCGGCGTTGCGGCTACCATCAAGCACTTCGTGTGCAACGACC

AGGAGCACGAGAGGCAGGCAGTGGATTCAATCGTCAGCGAAAGGGCAATCCGCGAAATCTACCTCATGCCGTT

CCAGATCGCGCAACGAGATGCACAGCCAATGGCCTACATGACTGCCTACAACCGCGTCAACGGTGTGCATATG

AGCGACAACAAGAAGATCCTCCAAGGCATTCTCCGTGATGAGTGGGGTTTTGACGGCTTGGTAATGAGTGACT

GGTATGATTTTCTCCTTCACGTCCTTTGAATCAGCCGCTCACGGAGACCAAAGGTTCGGCACCTACACGTCAG

CGGATTCCGTCAATGCCGGATTAGACCTCGAAATGCCTGGCCCGCCAAGGGTCCGTGGCCAGCAGACTCTGAT

CGCCCACAGCGTCCGTAAAATCTCCGATGACACCATTGATGAGCGTGTGCGAAAGGTGCTGGAGCTGGTCAAC

AAGGTTGACAAACTCAACATTCCTGAGAACGCGCCCGAGAGATCGATCGACTCTCCTGAAACGTCAAAGGCGC

TGCGCAATGTCGCAGCCTCTGGACTGGTACTCATGAAGAATGAGAAGAACGTCCTCCCCCCTCAAGAAAGAGCA

-continued

```
GTCGCTTGCTGTCATCGGTCCTAACGCTAAGATCGCAGCCTACGCTGGTGGCGGATCCGCCAACCTGAGGCCC

TACTACGCCGTCACCCCGTTGGAGGGGATCAGCGCGCAGAAGAGTGACGTTAAGTACTCTCTGGGAGCCGTCG

GATACAGGAGCTTGCCTGTTCTCAGCTACCTCACGAAGACAAAAGATGGGGACAGAGGCCTGACCGCGAGATT

CTTCAAAGAGCCTCCTACCGACAAGAGCCGCAAACACGTGGATGAAGTTCACGTCGAAGCATCAGATATTCTT

CTCTCCGACTACAAGCACCCCGAGATAACAAGTGACACGTTCTACATGGACCTGGAAGGAATACTGACACCGG

AGGAGTCTGGAGAGTACATCTTCGGCGTCTCTGTTTGCGGCACAGCAAAGCTGTTCATTGGGGACAAGCTGGT

GGTGGACAACACGGAGAACCAACGCCAGGGAGACACCTTCTTCGGGTCTGGCACAGTCGAAGAGACTGGCACC

ATGCAGCTGGAGGCTGGGAAGAGCTACCAAGTTTATCTGCAGTTTGGATCAAGCACCACATCGAACATGAAAA

CCCCAGGAGCAACAGTTATGGCAGGTGGAGGTGTGCGGGTTGGCGGTACGAAGCAGACGGACCCACAGGTGGA

GATTGAAAAAGCTGTCGTGCTTGCCAAGGAGGTGGATCAGGTGGTCGTCATTGCGGGCCTCAATGTGAGCAAC

CGTCCGGCAATTGCAAAGCAACTTTCGAAGACTGACATGAGTAGGGTGATTGGGAATCAGAAGGCTACGACCG

CAGGCACATGGACCTGCCCGGTTACACTGACGCGTTGATCTCCGCGGTAGCCGCTGCGAACCCCAACACAGCC

GTCGTCATGCAATCGGGCACTCCTGTCTGCATGCCCTGGATCGACGAGGTGCCTGCCCTCGTACACGCCTGGT

ATGGAGGCAACGAAACCGGAAACGCCATTGCAGACGTGATCTTTGGTACCGTCAACCCGTCTGGCAAGCTCTC

GCTCTCGTTTCCCGTCCGCAACGAGGACAACCCTGCCTTCCTCAACTTCCGCTCCGAGCGCGGCCGCGCTCTT

TACGGCGAGGATGTCTACATTGGATACCGCTTTTACGAGAAAACGAAGAGGGACGTCCTGTTTCCTTTCGGCC

ACGGTCTCTCATACACGTCTTTCGATATCAGCAACCTGCAGGTCACCGACGACGATGCGGGTGAAAAGATTAC

GATCAAGGTCGATGTCAAGAACACAGGCGCGCTCGAGGGCGCTCAGGTTGTGCAGGTTTACGTCAGCCAACGC

CACCCGTCGATTAACCGGCCTCCGAAGGAGCTGAAGGGGTTTGCCAAGGTTTTGCTCAAGCCTGGCGAGGTGA

GGCAGGCCACCGTTCATGTGTCAAAGAAATATGCGGCGAGTTTCTGGGATGAGCTGAAGGACGCGTGGATTAT

GGAGAAAGATGAGTATGATGTTTTGGTGGGCGACAGTAGTGCTAGTACGCCGCTGCAGGGAAGTTTCAAGGTG

GGCGAAACTTCGTGGTGGAAGGGGCTCTAGAGGTGACCGGGAAAAGCAGGATACGGACTCAGGCCGCTTGCAA

CAGAACGGGCCTTTTCTCGTCCATGACCGCTCGCTCATACTTGGTCGGTTTCGTGAGCACGAGACCTTTCCAC

GTTCCGGGGCGAGCCATGCAATTGTTTTGCCACA
```

SEQ ID NO: 83
LENGTH: 2499
TYPE: DNA
ORGANISM: M. phaseolina
FEATURE NAME/KEY: CDS
LOCATION: (1) (2499)

```
atggcgcccatagatgtcgaagatgcgctttcgaagctggagctgaacgagaaagtcgag
 M   A   P   I   D   V   E   D   A   L   S   K   L   E   L   N   E   K   V   E ctgctctctggcatcgatttctggcacaccaagcccatccctcgtcttggaatcccatcc
 L   L   S   G   I   D   F   W   H   T   K   P   I   P   R   L   G   I   P   S atacgcacatccgacggcccccaatggcgttcgtggcacccgcttcttcaacggcgtcccc
 I   R   T   S   D   G   P   N   G   V   R   G   T   R   F   F   N   G   V   P gctgcctgctttccctgcggtaccggactggcagccacctgggatgtcgacctcatccgc
 A   A   C   F   P   C   G   T   G   L   A   A   T   W   D   V   D   L   I   R gacggaggcaagctgatgggcaaggaggcaatcgcgaaaggcgcccatgtcattcttggc
 D   G   G   K   L   M   G   K   E   A   I   A   K   G   A   H   V   I   L   G ccgaccaccaacatgcagcgcggccccgcttggtagacggggggttcgaaagcttcagcgaa
 P   T   T   N   M   Q   R   G   P   L   G   R   R   G   F   E   S   F   S   E gatccgttccttgctggtgcaatgagtgccgctactgtggacgggatccagtcaaccggc
 D   P   F   L   A   G   A   M   S   A   A   T   V   D   G   I   Q   S   T   G gttgcggctaccatcaagcacttcgtgtgcaacgaccaggagcacgagaggcaggcagtg
 V   A   A   T   I   K   H   F   V   C   N   D   Q   E   H   E   R   Q   A   V gattcaatcgtcagcgaaagggcaatccgcgaaatctacctcatgccgttccagatcgcg
 D   S   I   V   S   E   R   A   I   R   E   I   Y   L   M   P   F   Q   I   A
```

-continued

```
caacgagatgcacagccaatggcctacatgactgcctacaaccgcgtcaacggtgtgcat
 Q  R  D  A  Q  P  M  A  Y  M  T  A  Y  N  R  V  N  G  V  H atgagcgacaacaagaagatcctccaaggcattctccgtgatgagtggggttttgacggc
 M  S  D  N  K  K  I  L  Q  G  I  L  R  D  E  W  G  F  D  G ttggtaatgagtgactggttcggcacctacacgtcagcggattccgtcaatgccggatta
 L  V  M  S  D  W  F  G  T  Y  T  S  A  D  S  V  N  A  G  L gacctcgaaatgcctggcccgccaagggtccgtggccagcagactctgatcgcccacagc
 D  L  E  M  P  G  P  P  R  V  R  G  Q  Q  T  L  I  A  H  S gtccgtaaaatctccgatgacaccattgatgagcgtgtgcgaaaggtgctggagctggtc
 V  R  K  I  S  D  D  T  I  D  E  R  V  R  K  V  L  E  L  V aacaaggttgacaaactcaacattcctgagaacgcgcccgagagatcgatcgactctcct
 N  K  V  D  K  L  N  I  P  E  N  A  P  E  R  S  I  D  S  P gaaacgtcaaaggcgctgcgcaatgtcgcagcctctggactggtactcatgaagaatgag
 E  T  S  K  A  L  R  N  V  A  A  S  G  L  V  L  M  K  N  E aagaacgtcctcccccctcaagaaagagcagtcgcttgctgtcatcggtcctaacgctaag
 K  N  V  L  P  L  K  K  E  Q  S  L  A  V  I  G  P  N  A  K atcgcagcctacgctggtggcggatccgccaacctgaggccctactacgccgtcaccccg
 I  A  A  Y  A  G  G  G  S  A  N  L  R  P  Y  Y  A  V  T  P ttggaggggatcagcgcgcagaagagtgacgttaagtactctctgggagccgtcggatac
 L  E  G  I  S  A  Q  K  S  D  V  K  Y  S  L  G  A  V  G  Y aggagcttgcctgttctcagctacctcacgaagacaaaagatggggacagaggcctgacc
 R  S  L  P  V  L  S  Y  L  T  K  T  K  D  G  D  R  G  L  T gcgagattcttcaaagagcctcctaccgacaagagccgcaaacacgtggatgaagttcac
 A  R  F  F  K  E  P  P  T  D  K  S  R  K  H  V  D  E  V  H gtcgaagcatcagatattcttctctccgactacaagcaccccgagataacaagtgacacg
 V  E  A  S  D  I  L  L  S  D  Y  K  H  P  E  I  T  S  D  T ttctacatggacctggaaggaatactgacaccggaggagtctggagagtacatcttcggc
 F  Y  M  D  L  E  G  I  L  T  P  E  E  S  G  E  Y  I  F  G gtctctgtttgcggcacagcaaagctgttcattggggacaagctggtggtggacaacacg
 V  S  V  C  G  T  A  K  L  F  I  G  D  K  L  V  V  D  N  T gagaaccaacgccagggagacaccttcttcgggtctggcacagtcgaagagactggcacc
 E  N  Q  R  Q  G  D  T  F  F  G  S  G  T  V  E  E  T  G  T atgcagctggaggctgggaagagctaccaagtttatctgcagtttggatcaagcaccaca
 M  Q  L  E  A  G  K  S  Y  Q  V  Y  L  Q  F  G  S  S  T  T tcgaacatgaaaaccccaggagcaacagttatggcaggtggaggtgtgcgggttggcggt
 S  N  M  K  T  P  G  A  T  V  M  A  G  G  G  V  R  V  G  G acgaagcagacggacccacaggtggagattgaaaaagctgtcgtgcttgccaaggaggtg
 T  K  Q  T  D  P  Q  V  E  I  E  K  A  V  V  L  A  K  E  V gatcaggtggtcgtcattgcgggcctcaatggtgattgggaatcagaaggctacgaccgc
 D  Q  V  V  V  I  A  G  L  N  G  D  W  E  S  E  G  Y  D  R aggcacatggacctgcccggttacactgacgcgttgatctccgcggtagccgctgcgaac
 R  H  M  D  L  P  G  Y  T  D  A  L  I  S  A  V  A  A  N cccaacacagccgtcgtcatgcaatcgggcactcctgtctgcatgccctggatcgacgag
 P  N  T  A  V  V  M  Q  S  G  T  P  V  C  M  P  W  I  D  E gtgcctgccctcgtacacgcctggtatggaggcaacgaaaccggaaacgccattgcagac
 V  P  A  L  V  H  A  W  Y  G  G  N  E  T  G  N  A  I  A  D gtgatctttggtaccgtcaacccgtctggcaagctctcgctctcgtttcccgtccgcaac
 V  I  F  G  T  V  N  P  S  G  K  L  S  L  S  F  P  V  R  N gaggacaaccctgccttcctcaacttccgctccgagcgcggccgcgctctttacggcgag
 E  D  N  P  A  F  L  N  F  R  S  E  R  G  R  A  L  Y  G  E gatgtctacattggataccgcttttacgagaaaacgaagagggacgtcctgtttcctttc
 D  V  Y  I  G  Y  R  F  Y  E  K  T  K  R  D  V  L  F  P  F ggccacggtctctcatacacgtctttcgatatcagcaacctgcaggtcaccgacgacgat
 G  H  G  L  S  Y  T  S  F  D  I  S  N  L  Q  V  T  D  D  D
```

```
gcgggtgaaaagattacgatcaaggtcgatgtcaagaacacaggcgcgctcgagggcgct
 A  G  E  K  I  T  I  K  V  D  V  K  N  T  G  A  L  E  G  A caggttgtgcaggtttacgtcagccaacgccacccgtcgattaaccggcctccgaaggag
 Q  V  V  Q  V  Y  V  S  Q  R  H  P  S  I  N  R  P  P  K  E ctgaaggggtttgccaaggttttgctcaagcctggcgaggtgaggcaggccaccgttcat
 L  K  G  F  A  K  V  L  L  K  P  G  E  V  R  Q  A  T  V  H gtgtcaaagaaatatgcggcgagtttctgggatgagctgaaggacgcgtggattatggag
 V  S  K  K  Y  A  A  S  F  W  D  E  L  K  D  A  W  I  M  E aaagatgagtatgatgttttggtgggcgacagtagtgctagtacgccgctgcagggaagt
 K  D  E  Y  D  V  L  V  G  D  S  S  A  S  T  P  L  Q  G  S ttcaaggtgggcgaaacttcgtggtggaaggggctctag
 F  K  V  G  E  T  S  W  W  K  G  L  -
```

SEQ ID NO: 84
LENGTH: 832
TYPE: PRT
ORGANISM: M. phaseolina
MAPIDVEDALSKLELNEKVELLSGIDFWHTKPIPRLGIPSIRTSDGPNGVRGTRFFNGVPAACFPCGTGLAAT

WDVDLIRDGGKLMGKEAIAKGAHVILGPTTNMQRGPLGRRGFESFSEDPFLAGAMSAATVDGIQSTGVAATIK

HFVCNDQEHERQAVDSIVSERAIREIYLMPFQIAQRDAQPMAYMTAYNRVNGVHMSDNKKILQGILRDEWGFD

GLVMSDWFGTYTSADSVNAGLDLEMPGPPRVRGQQTLIAHSVRKISDDTIDERVRKVLELVNKVDKLNIPENA

PERSIDSPETSKALRNVAASGLVLMKNEKNVLPLKKEQSLAVIGPNAKIAAYAGGGSANLRPYYAVTPLEGIS

AQKSDVKYSLGAVGYRSLPVLSYLTKTKDGDRGLTARFFKEPPTDKSRKHVDEVHVEASDILLSDYKHPEITS

DTFYMDLEGILTPEESGEYIFGVSVCGTAKLFIGDKLVVDNTENQRQGDTFFGSGTVEETGTMQLEAGKSYQV

YLQFGSSTTSNMKTPGATVMAGGGVRVGGTKQTDPQVEIEKAVVLAKEVDQVVVIAGLNGDWESEGYDRRHMD

LPGYTDALISAVAAANPNTAVVMQSGTPVCMPWIDEVPALVHAWYGGNETGNAIADVIFGTVNPSGKLSLSFP

VRNEDNPAFLNFRSERGRALYGEDVYIGYRFYEKTKRDVLFPFGHGLSYTSFDISNLQVTDDDAGEKITIKVD

VKNTGALEGAQVVQVYVSQRHPSINRPPKELKGFAKVLLKPGEVRQATVHVSKKYAASFWDELKDAWIMEKDE

YDVLVGDSSASTPLQGSFKVGETSWWKGL*

SEQ ID NO: 85
LENGTH: 2807 (including 150 bp 5' UTR and 150 bp 3' UTR)
TYPE: DNA
ORGANISM: M. phaseolina
GAGCCATATCGCCAAGCACAGGACATCGGCATGATGTCGTGAGAACATAGCTCCGCACGGCCTACGCCGCTAT

ATAACCGTGTGAGGGCTCCGCCAAAATTCCCGCCTTCAAGGAAAGTCCGCCAACTTCATCTTTCCCCTTGACG

AGCCATGAGGTCCGCTGTCTACGCCGTCGCCTCCGTTCTGGCCGCTGCTGCCCCGGCATGCGCCGCTGAGAAC

TACACCTGGGCCAATCCTCCCTCTGAAGTTCCCTACTACGGCCTGAGTCCTCCCGTCTATCCTACCCGTACGC

CATCACCATTTCCTTGTGAATCCCAATCTGATTGTTTCGGCAGCTCAAGGAACCGGAAACTCGTCGACAGCAT

GGGCTGCCGCCTACGAAAAGGCTCGCGCCCTGGTCGCTCAGCTGACGCAGGATGAAAAGTCCAATTTGACGCG

CGGCTACACTGGTGCTTGCGTTGGCAACACTGGTGCCATTCCTCGCCTGGGAATCGAACCTCTCTGCTTCGCG

GATGCTCCCGATGGCATCAGAGGCTCTGATTTCGTGTCGGCCTTTCCCTCGCAGCTCCACCTTGCAACCACTT

GGGATAGGAACTTGATGTACCAGTACGGAAAGGCCCTCGGCGAAGAATATCACGACAAGGGCATTAATGTTGC

TCTTGGCCCTGTCGCCGGCCCGCTTGGAAGAATTGCGAAGGGCGGGCGAAACTGGGAAGGTCTGCTTTCCCAG

AACAGTCATCTTACATTAGTTGCTAATGAGGTTGAGAATAGGTCTAAGCCATGACCCGTACTTGGCCGGTGTG

GGTATGTATGAGGTCACTCAAGCTATGCAGTCGGCCGGCGTCATTGCTGTCGCGAAGGTGAGTCGATTGGGCC

AGCTCTTGAGCTGAGTTTCCGCACGTGACGGTGTCTAAAACGGAGCACAGCATTTTCTGCTCAACGAGCAAGA

ATACCGACGACTTCCGAATCAGTCTGCAACCGTCCCTTCCACAGGCCAAGTGATCAAGGAGCCCCAAGGTCAG

GCTATCTCGTCGAACGCGGATGACAAAACGATCCACGAACTCTATGCCTGGCCATTTTACGATGCTCTCAAGG

CGGGTGCCGCATCCATCATGTGCAGTTATAACAGAGTCAACAACTCGTACGCTTGCCAAAATTCCAAGCTCAT

-continued

```
GAACGGCCTCCTTAAAACCGAGATGGGCTTCGAAGGGTTTGTCGTCAGTGACTGGCAAGGCCAACACACGGGT

GTTGCGTCTGCAAACGCTGGCCTCGATGTCGTCATGCCCGATGGCGGCTTCTGGGGTGCCAACCTCACAGAGG

CGGTCAACAACGGCTCGGTAAGTGCGGAGCGTTTTGACGACATGGCAACCCGTGTCCTGGCTGCCTACTATCT

CTTGAACCAAGACGAAGATTTCCCGGAGATTGGCGTTTTCTCTGATACCGTTGAGCACCCCATCGTAGACGTC

CGCGGTGAACATGACAAAGTCATACGAGAGGTCGGCACTGCTGGCCACGTACTTGTCAAGAATGTCAACAACG

CTCTGCCGCTCCAGAACCCGAAGTTCGTCGCCATCTACGGATATGATGCGGACGTCAAGGCGGCACCTTGGGA

AAATGTTGCTCGCTATGGCGGCGGCTACGAGGTCAATTATGGTTGGAACACATTCAATGGAACCCTCATAACC

GGTGGAGGTTCCGGAGGCGCGTCACCGCCGTATGTGATCAGCCCGTTTAAAGCCATCCAAGATGGGTTATTC

AAGATCATGGCATCGTCCGCTGGAATTTCTGGGATGTTAATCCTCATGTCTCGGCGACTGCGCAAGTTTGCTT

GGTGTTCATCAACGCTTACGCGTCCGAGAGCTTCGATCGCCCCTCCCTCACGGATGAATTCAGTGACGAGCTG

GTGAAGAACGTCGCCACTAACTGCTCCAACACCGTCGTGGTTGTCCATTCCGCTGGCATCCGCATCGTCGATG

CTTGGATCGAGCACGAGAACGTCACCGCTGTCATATTCGCTGGTCTGCCCGGCCAGGAGAGTGGTCACAGTCT

TGTGGATATCCTGTACGGAGACGTCAGTCCGAGCGGAAAGCTCACCTACACTGTGGCTAAGACGGAGGAAGAC

TACGGCCTCCTTCTCAACCACACAGAGGACGACAGCTTTTTCCCGCAGAGCAATTTCTCCGAAGGTATCTACA

TTGATTATAGAGCCTTCGACAAGGATGGTATTGAGCCACGCTTCGAGTTCGGCTTTGGCCTTTCCTACTCTGA

ATTCGAGTACTCCAACATCGAAATCAACTCCCTCAATGGGAACACTGACGCTTTCCCGCCAGAGGCTGCCATT

GTACAGGGCGGCCACCCTGCTCTGTGGGACGTCCTCTACAACGTTACGGCTGAGATCGAGAATATCGGAAATT

ATACTGCCCAGGAGGTCGCCCAGCTCTATGTCGGTATCCCCACCGGCCCCGTCCGCCAGCTCCGTGGTTTCGA

CAAAGTCGCTACTGAGCCTGGCCAGAAGGTTAGCGTCAGCTTCCCCTTGAAGCGCCGTGACCTGAGCGTGTGG

AATGTTGTAGCTCAGCAGTGGGAGTTGCAGTCTGGTGATTACCCGATTTGGATCGGTGCAAGCAGCAGGGATC

TGAGATTGAACGCGACCATCACGATTTAGGGGGGAAGCACCTGAGAAGTCAATGAATTTTCTGAACACTGGTC

AGACTTAATGCGTGTACAGTTGATGGAAATAATAGACTAATGTCATACTGACTGCATCGACGTCCAAGCGATA

CTTTCATTCCACGAGCCCCCTAGTTTCTTGGAG
```

```
SEQ ID NO: 86
LENGTH: 2337
TYPE: DNA
ORGANISM: M. phaseolina
FEATURE NAME/KEY: CDS
LOCATION: (1)...(2337)
tgaggtccgctgtctacgccgtcgcctccgttctggccgctgctgccccggcatgcgcc
 M   R   S   A   V   Y   A   V   A   S   V   L   A   A   A   A   P   A   C   A gctgagaactacacctgggccaatcctccctctgaagttccctactacggcctgagtcct
 A   E   N   Y   T   W   A   N   P   P   S   E   V   P   Y   Y   G   L   S   P cccgtctatcctacccctcaaggaaccggaaactcgtcgacagcatgggctgccgcctac
 P   V   Y   P   T   P   Q   G   T   G   N   S   S   T   A   W   A   A   A   Y gaaaaggctcgcgcccggtcgctcagctgacgcaggatgaaaagtccaatttgacgcgc
 E   K   A   R   A   L   V   A   Q   L   T   Q   D   E   K   S   N   L   T   R ggctacactggtgcttgcgttggcaacactggtgccattcctcgcctgggaatcgaacct
 G   Y   T   G   A   C   V   G   N   T   G   A   I   P   R   L   G   I   E   P ctctgcttcgcggatgctcccgatggcatcagaggctctgatttcgtgtcggccttccc
 L   C   F   A   D   A   P   D   G   I   R   G   S   D   F   V   S   A   F   P tcgcagctccaccttgcaaccacttgggataggaacttgatgtaccagtacggaaaggcc
 S   Q   L   H   L   A   T   T   W   D   R   N   L   M   Y   Q   Y   G   K   A ctcggcgaagaatatcacgacaagggcattaatgttgctcttggccctgtcgccggcccg
 L   G   E   E   Y   H   D   K   G   I   N   V   A   L   G   P   V   A   G   P cttggaagaattgcgaaggggcgggcgaaactgggaaggtctaagccatgacccgtacttg
 L   G   R   I   A   K   G   G   R   N   W   E   G   L   S   H   D   P   Y   L gccggtgtgggtatgtatgaggtcactcaagctatgcagtcggccggcgtcattgctgtc
 A   G   V   G   M   Y   E   V   T   Q   A   M   Q   S   A   G   V   I   A   V
```

-continued

```
gcgaagcattttctgctcaacgagcaagaataccgacgacttccgaatcagtctgcaacc
 A  K  H  F  L  L  N  E  Q  E  Y  R  R  L  P  N  Q  S  A  T gtcccttccacaggccaagtgatcaaggagccccaaggtcaggctatctcgtcgaacgcg
 V  P  S  T  G  Q  V  I  K  E  P  Q  G  Q  A  I  S  S  N  A gatgacaaaacgatccacgaactctatgcctggccattttacgatgctctcaaggcggt
 D  D  K  T  I  H  E  L  Y  A  W  P  F  Y  D  A  L  K  A  G gccgcatccatcatgtgcagttataacagagtcaacaactcgtacgcttgccaaaattcc
 A  A  S  I  M  C  S  Y  N  R  V  N  N  S  Y  A  C  Q  N  S aagctcatgaacggcctccttaaaaccgagatgggcttcgaagggtttgtcgtcagtgac
 K  L  M  N  G  L  L  K  T  E  M  G  F  E  G  F  V  V  S  D tggcaaggccaacacacgggtgttgcgtctgcaaacgctggcctcgatgtcgtcatgccc
 W  Q  G  Q  H  T  G  V  A  S  A  N  A  G  L  D  V  V  M  P gatggcggcttctggggtgccaacctcacagaggcggtcaacaacggctcggtaagtgcg
 D  G  G  F  W  G  A  N  L  T  E  A  V  N  N  G  S  V  S  A gagcgttttgacgacatggcaacccgtgtcctggctgcctactatctcttgaaccaagac
 E  R  F  D  D  M  A  T  R  V  L  A  A  Y  Y  L  L  N  Q  D gaagatttcccggagattggcgttttctctgataccgttgagcacccatcgtagacgtc
 E  D  F  P  E  I  G  V  F  S  D  T  V  E  H  P  I  V  D  V cgcggtgaacatgacaaagtcatacgagaggtcggcactgctggccacgtacttgtcaag
 R  G  E  H  D  K  V  I  R  E  V  G  T  A  G  H  V  L  V  K aatgtcaacaacgctctgccgctccagaacccgaagttcgtcgccatctacggatatgat
 N  V  N  N  A  L  P  L  Q  N  P  K  F  V  A  I  Y  G  Y  D gcggacgtcaaggcggcaccttgggaaaatgttgctcgctatggcggcggctacgaggtc
 A  D  V  K  A  A  P  W  E  N  V  A  R  Y  G  G  G  Y  E  V aattatggttggaacacattcaatggaaccctcataaccggtggaggttccggaggcgcg
 N  Y  G  W  N  T  F  N  G  T  L  I  T  G  G  S  G  G  A tcaccgccgtatgtgatcagcccgtttaaagccatccaagatcgggttattcaagatcat
 S  P  P  Y  V  I  S  P  F  K  A  I  Q  D  R  V  I  Q  D  H ggcatcgtccgctggaatttctgggatgttaatcctcatgtctcggcgactgcgcaagtt
 G  I  V  R  W  N  F  W  D  V  N  P  H  V  S  A  T  A  Q  V tgcttggtgttcatcaacgcttacgcgtccgagagcttcgatcgcccctccctcacggat
 C  L  V  F  I  N  A  Y  A  S  E  S  F  D  R  P  S  L  T  D gaattcagtgacgagctggtgaagaacgtcgccactaactgctccaacaccgtcgtggtt
 E  F  S  D  E  L  V  K  N  V  A  T  N  C  S  N  T  V  V  V gtccattccgctggcatccgcatcgtcgatgcttggatcgagcacgagaacgtcaccgct
 V  H  S  A  G  I  R  I  V  D  A  W  I  E  H  E  N  V  T  A gtcatattcgctggtctgcccggccaggagagtggtcacagtcttgtggatatcctgtac
 V  I  F  A  G  L  P  G  Q  E  S  G  H  S  L  V  D  I  L  Y ggagacgtcagtccgagcgaaagctcacctacactgtggctaagacggaggaagactac
 G  D  V  S  P  S  G  K  L  T  Y  T  V  A  K  T  E  E  D  Y ggcctccttctcaaccacacagaggacgacagcttttttcccgcagagcaatttctccgaa
 G  L  L  L  N  H  T  E  D  D  S  F  F  P  Q  S  N  F  S  E ggtatctacattgattatagagccttcgacaaggatggtattgagccacgcttcgagttc
 G  I  Y  I  D  Y  R  A  F  D  K  D  G  I  E  P  R  F  E  F ggctttggccttcctactctgaattcgagtactccaacatcgaaatcaactccctcaat
 G  F  G  L  S  Y  S  E  F  E  Y  S  N  I  E  I  N  S  L  N gggaacactgacgctttcccgccagaggctgccattgtacagggcggccaccctgctctg
 G  N  T  D  A  F  P  P  E  A  A  I  V  Q  G  G  H  P  A  L tgggacgtcctctacaacgttacggctgagatcgagaatatcggaaattatactgcccag
 W  D  V  L  Y  N  V  T  A  E  I  E  N  I  G  N  Y  T  A  Q gaggtcgcccagctctatgtcggtatccccaccggccccgtccgccagctccgtggtttc
 E  V  A  Q  L  Y  V  G  I  P  T  G  P  V  R  Q  L  R  G  F gacaaagtcgctactgagcctggccagaaaggttagcgtcagcttccccttgaagcgccgt
 D  K  V  A  T  E  P  G  Q  K  V  S  V  S  F  P  L  K  R  R
```

-continued
```
gacctgagcgtgtggaatgttgtagctcagcagtgggagttgcagtctggtgattacccg
 D   L   S   V   W   N   V   V   A   Q   Q   W   E   L   Q   S   G   D   Y   P atttggatcggtgcaagcagcagggatctgagattgaacgcgaccatcacgatttag
 I   W   I   G   A   S   S   R   D   L   R   L   N   A   T   I   T   I   -
```

SEQ ID NO: 87
LENGTH: 778
TYPE: PRT
ORGANISM: *M. phaseolina*
MRSAVYAVASVLAAAAPACAAENYTWANPPSEVPYYGLSPPVYPTPQGTGNSSTAWAAAYEKARALVAQLTQD

EKSNLTRGYTGACVGNTGAIPRLGIEPLCFADAPDGIRGSDFVSAFPSQLHLATTWDRNLMYQYGKALGEEYH

DKGINVALGPVAGPLGRIAKGGRNWEGLSHDPYLAGVGMYEVTQAMQSAGVIAVAKHFLLNEQEYRRLPNQSA

TVPSTGQVIKEPQGQAISSNADDKTIHELYAWPFYDALKAGAASIMCSYNRVNNSYACQNSKLMNGLLKTEMG

FEGFVVSDWQGQHTGVASANAGLDVVMPDGGFWGANLTEAVNNGSVSAERFDDMATRVLAAYYLLNQDEDFPE

IGVFSDTVEHPIVDVRGEHDKVIREVGTAGHVLVKNVNNALPLQNPKFVAIYGYDADVKAAPWENVARYGGGY

EVNYGWNTFNGTLITGGGSGGASPPYVISPFKAIQDRVIQDHGIVRWNFWDVNPHVSATAQVCLVFINAYASE

SFDRPSLTDEFSDELVKNVATNCSNTVVVVHSAGIRIVDAWIEHENVTAVIFAGLPGQESGHSLVDILYGDVS

PSGKLTYTVAKTEEDYGLLLNHTEDDSFFPQSNFSEGIYIDYRAFDKDGIEPRFEFGFGLSYSEFEYSNIEIN

SLNGNTDAFPPEAAIVQGGHPALWDVLYNVTAEIENIGNYTAQEVAQLYVGIPTGPVRQLRGFDKVATEPGQK

VSVSFPLKRRDLSVWNVVAQQWELQSGDYPIWIGASSRDLRLNATITI*

SEQ ID NO: 88
LENGTH: 2860 (including 150 bp 5' UTR and 150 bp 3' UTR)
TYPE: DNA
ORGANISM: *M. phaseolina*
CCCTTCCGGGGACGCGTCAGATGGCCGAAGCTCGAGGAAGTGCCCCATTTCCGGACGATGAGTATTTTATACC

TTCATGAGCTCTGCTAGTCACGATTAGCAAAAGCACCTGTCTCTCTTTTCCCCAGGCTCGAGCCTTCCACTAA

GCCAATGCGTCCGTCCCTATCCGTTCTCCCCGCCCTGACCCTTTTGGTCCGGGGCCTCAGTGCCTATTCCACT

AACTACACGAGTCAGAATCTTGCCTCTGGCACTAGTGAGTTTCCTTGGAATCCTGAAACCCATGCGCAGCAAA

CCTAAGAGGCATTAAATGTTCTTGTTGTCTCGTGGAACAATATATCTTCGATCGCGTTCCCATGTCAACTTTG

TTCGTGTCTCAGCGCAGAGGCTGACCGCGTGTAGTCAAACTCGGCGACTGGCAAGATGCCTACGACCGCGCAA

AGACCTTTGTTGATGGTCTCAGCAATTCCGAAAAGATTTCTCTGATCACTGGCTCCGATGTCTCCAACTTCAC

TGCCCTTTACTTCAGAGACTCTGGTGATTCCATCCTCCAATACTACTTTGTGACTACCTGGTCAGTCCCAAAC

ACATTGTCACCCTGTCCCACAATTATACTAACTTCTGCAGGCCCCTTTCATCTGCCCTTGCCATGACTTGGGA

CAAGAAGATGATGTACCAGATGTACAAAGCTCTTGGCGACGAGTTCTACGCCAAGGGCATCAACGTTGCCAAT

GGCCCCGTTAGTCAGCCTCTTGGCCGTTCGCCATGGGGCGGACGTAACGGAGAATCCTTCGGTCCCGATTCGT

ACTTAAACGGCATCGCCTTCGGCCTCTCCGTCAAGGGGTACGGAGATGCTGGTGTCATTTCTGGAGCCAAGCA

TTTCCTTTTAAACGAGCAAGAGAACAACCGTACCCAGGATTCGACCGGTGGGGGCGGTGGAGGCTCTCCACCA

AACGATGGCGGCAATCCGACTACGCCCGGTAGTGGCGCTGCTCCAACTGGCGGCATGGGCGGTGGAGCTAGTA

GCGATTCGTCAAGCTCTGAGTCCATTGCATACTCTTCGCAGGTAGACGACAAGACCCTGCACGAGACTTACAT

GTGGCCCTTTTTCGATGGCGTCAAGGCTGGTTTGGGTGCCGTTATGTGCGCTCTCAACCGTGTCAACGAGACC

TACGCCTGTGAGAACCAGGACCTAATTGCTGGCAAGCTCAAGAGCGAGATAGGGTTTCCCGGCTTCGTTTTTG

GTGATGTTGGCGGCCAAAAGACTGCTTTCGGGTCTGCCAACGCCGGCATGGACTATGGCAGCTCTTCAACGTG

GAGCAACAGCACCATGCTCGCCGGGCTGAACAACGGCTCGTTGACTGAGGCTCGCCTGACCGACATGGCCGTC

CGCAATGTTCTCCCGTCCTACAAATTCAATCAGCAGGACGGCACATATCCTACTACCGCTGGTCTTGAGGATT

ACGTAGACCCGAGGGCCAACCACAGCAAGATCGCCAGGAGCATTGCTGCTTCCTCACTGGTCCTTTTGAAGAA

CGAGAACAATGCTCTACCCCTCAAAAAGCCCAAGTCCATGTCCATCTTCGGCGTTCATGCCGGAGCAGCCATC

GCCGGACCCAATGATCCCATTTCTGTCACCGGTTCCGACGACATCTACCAGGGCCACGCCGCCTCCCTTGGTG

-continued

GAAGCGGAACTGGCTCCTTTCCTTACCTCGTTACTCCTCACTACGCTTTGACCACCAAAGTCATTGAGGACGG

CACTATGTTCCGCTGGATCATGAACGACACAGGCTACACCTCCACGAGCGGCGGCCTCTCTGGCTACTCGTCC

GGCACTGGTGCCGCCCATACCTACAGCGGCTACGCCACGGACTCCGAAGTCTGCATCGTCTTCCTCAACGCCT

ACTCGGGCGAGGGCGCGGACCGCAGTGCACTCTACAACACCGACCAAGACGGCATGGTCGCCTCGGTCGCCTC

GGCCTGCAATAACACCATCGTCGTCATCAACGCCGTCGCCGCGCGCCTCGTCGACGCGTGGATCGACAACGTT

AACATTACCGCCGTCGTCTATGGCAGCATGCTGGGCCAAGAATCCGCCACGCCATCGTCGACGTCCTCTACG

GCGCCGTAAACCCGTCCGGCAAACTCACCTACACCATCGCCAAGAACGAGTCCGACTACAACACCGGCCTTTG

CACCGACCTCATCTGCGACTTCTCCGAGGGCAACTACATTGACTACAAGTACTTCGACGCCTACAACGTCACC

CCGCGCTACGAGTTCGGCTACGGCCTCTCGTACACGACCTTCAAGTACGCAGACACCCTCTCCGTCGCGAAAA

CGAACGGCTCCGCCCTCGCCCGCACGTACGCCACTGGCCCGCTCGCCGTCGGCGGCCGCGAGGACCTGTGGGA

CGTCGTCGCCACCGCCGAGACCAGCATCGCCAACACCGGCGAGCGCGACGGCGCCGAGGCGGCGCAGCTGTAC

GTCAAGTTTCCCGCCGCGCGGGCCAGCCGCTGCGCCAGCTACGCGGGTTCGAGAAGGTGCATCTGGCCAAGG

GCGCGGAGCAGAAGGTGAAGTTCGAGCTGCGCAGGAGGGATCTGAGTTATTGGGATGTCGAGGCGCAGAATTG

GGCGGTTGCGAGGGGCACGTATGAGTTCTTCGTCGGCGCGAGTAGTAGGGACTTGAAGGCGCACGCGATTCTA

ACCGTTTGAGGAGATGGGCGATGAGCTATTGAGGCGCGCTGATGATTGGGGGAAAGGAGGGGGGGGGGGGGG

GGGGCGTTGAGAGCGCCGGAATAGCGGTTTTTGCTTCACTTCTCATATGTATACGCATCTAGACGGTACATAT

CTGTACAAAAATG

SEQ ID NO: 89
LENGTH: 2361
TYPE: DNA
ORGANISM: M. phaseolina
FEATURE NAME/KEY: CDS
LOCATION: (1)...(2361)

atgcgtccgtccctatccgttctccccgccctgacccttttggtccggggcctcagtgcc
 M   R   P   S   L   S   V   L   P   A   L   T   L   L   V   R   G   L   S   A tattccactaactacacgagtcagaatcttgcctctggcactatcaaactcggcgactgg
 Y   S   T   N   Y   T   S   Q   N   L   A   S   G   T   I   K   L   G   D   W caagatgcctacgaccgcgcaaagacctttgttgatggtctcagcaattccgaaaagatt
 Q   D   A   Y   D   R   A   K   T   F   V   D   G   L   S   N   S   E   K   I tctctgatcactggctccgatgtctccaacttcactgcccttacttcagagactctggt
 S   L   I   T   G   S   D   V   S   N   F   T   A   L   Y   F   R   D   S   G gattccatcctccaatactactttgtgactacctggccccttcatctgcccttgccatg
 D   S   I   L   Q   Y   Y   F   V   T   T   W   P   L   S   S   A   L   A   M acttgggacaagaagatgatgtaccagatgtacaaagctcttggcgacgagttctacgcc
 T   W   D   K   K   M   M   Y   Q   M   Y   K   A   L   G   D   E   F   Y   A aagggcatcaacgttgccaatggcccccgttagtcagcctcttggccgttcgccatgggc
 K   G   I   N   V   A   N   G   P   V   S   Q   P   L   G   R   S   P   W   G ggacgtaacggagaatccttcggtcccgattcgtacttaaacggcatcgccttcggcctc
 G   R   N   G   E   S   F   G   P   D   S   Y   L   N   G   I   A   F   G   L tccgtcaaggggtacggagatgctggtgtcatttctggagccaagcatttccttttaaac
 S   V   K   G   Y   G   D   A   G   V   I   S   G   A   K   H   F   L   L   N gagcaagagaacaaccgtacccaggattcgaccggtggggcggtggaggctctccacca
 E   Q   E   N   N   R   T   Q   D   S   T   G   G   G   G   G   S   P   P aacgatggcggcaatccgactacgccggtagtggcgctgctccaactggcggcatgggc
 N   D   G   G   N   P   T   T   P   G   S   G   A   A   P   T   G   G   M   G ggtggagctagtagcgattcgtcaagctctgagtccattgcatactcttcgcaggtagac
 G   G   A   S   S   D   S   S   S   E   S   I   A   Y   S   S   Q   V   D gacaagacccctgcacgagacttacatgtggcccttttcgatggcgtcaaggctggtttg
 D   K   T   L   H   E   T   Y   M   W   P   F   F   D   G   V   K   A   G   L ggtgccgttatgtgcgctctcaaccgtgtcaacgagacctacgcctgtgagaaccaggac
 G   A   V   M   C   A   L   N   R   V   N   E   T   Y   A   C   E   N   Q   D

```
ctaattgctggcaagctcaagagcgagatagggtttcccggcttcgttttggtgatgtt
 L  I  A  G  K  L  K  S  E  I  G  F  P  G  F  V  F  G  D  V ggcggccaaaagactgctttcgggtctgccaacgccggcatggactatggcagctctca
 G  G  Q  K  T  A  F  G  S  A  N  A  G  M  D  Y  G  S  S  S acgtggagcaacagcaccatgctcgccgggctgaacaacggctcgttgactgaggctcgc
 T  W  S  N  S  T  M  L  A  G  L  N  N  G  S  L  T  E  A  R ctgaccgacatggccgtccgcaatgttctcccgtcctacaaattcaatcagcaggacggc
 L  T  D  M  A  V  R  N  V  L  P  S  Y  K  F  N  Q  Q  D  G acatatcctactaccgctggtcttgaggattacgtagacccgagggccaaccacagcaag
 T  Y  P  T  T  A  G  L  E  D  Y  V  D  P  R  A  N  H  S  K atcgccaggagcattgctgcttcctcactggtccttttgaagaacgagaacaatgctcta
 I  A  R  S  I  A  A  S  S  L  V  L  L  K  N  E  N  N  A  L cccctcaaaaagcccaagtccatgtccatcttcggcgttcatgccggagcagccatcgcc
 P  L  K  K  P  K  S  M  S  I  F  G  V  H  A  G  A  A  I  A ggacccaatgatcccatttctgtcaccggttccgacgacatctaccagggccacgccgcc
 G  P  N  D  P  I  S  V  T  G  S  D  D  I  Y  Q  G  H  A  A tcccttggtggaagcggaactggctccttttccttacctcgttactcctcactacgctttg
 S  L  G  G  S  G  T  G  S  F  P  Y  L  V  T  P  H  Y  A  L accaccaaagtcattgaggacggcactatgttccgctggatcatgaacgacacaggctac
 T  T  K  V  I  E  D  G  T  M  F  R  W  I  M  N  D  T  G  Y acctccacgagcggcggcctctctggctactcgtccggcactggtgccgcccatacctac
 T  S  T  S  G  G  L  S  G  Y  S  S  G  T  G  A  A  H  T  Y agcggctacgccacggactccgaagtctgcatcgtcttcctcaacgcctactcgggcgag
 S  G  Y  A  T  D  S  E  V  C  I  V  F  L  N  A  Y  S  G  E ggcgcggaccgcagtgcactctacaacaccgaccaagacggcatggtcgcctcggtcgcc
 G  A  D  R  S  A  L  Y  N  T  D  Q  D  G  M  V  A  S  V  A tcggcctgcaataacaccatcgtcgtcatcaacgccgtcgccgcgcgcctcgtcgacgcg
 S  A  C  N  N  T  I  V  V  I  N  A  V  A  A  R  L  V  D  A tggatcgacaacgttaacattaccgccgtcgtctatggcagcatgctgggccaagaatcc
 W  I  D  N  V  N  I  T  A  V  V  Y  G  S  M  L  G  Q  E  S ggccacgccatcgtcgacgtcctctacggcgcgccgtaaacccgtccggcaaactcacctac
 G  H  A  I  V  D  V  L  Y  G  A  V  N  P  S  G  K  L  T  Y accatcgccaagaacgagtccgactacaacaccggcctttgcaccgacctcatctgcgac
 T  I  A  K  N  E  S  D  Y  N  T  G  L  C  T  D  L  I  C  D ttctccgagggcaactacattgactacaagtacttcgacgcctacaacgtcaccccgcgc
 F  S  E  G  N  Y  I  D  Y  K  Y  F  D  A  Y  N  V  T  P  R tacgagttcggctacggcctctcgtacacgaccttcaagtacgcagacaccctctccgtc
 Y  E  F  G  Y  G  L  S  Y  T  T  F  K  Y  A  D  T  L  S  V gcgaaaacgaacggctccgccctcgcccgcacgtacgccactggcccgctcgccgtcggc
 A  K  T  N  G  S  A  L  A  R  T  Y  A  T  G  P  L  A  V  G ggccgcgaggacctgtgggacgtcgtcgccaccgccgagaccagcatcgccaacaccggc
 G  R  E  D  L  W  D  V  V  A  T  A  E  T  S  I  A  N  T  G gagcgcgacggcgccgaggcggcgcagctgtacgtcaagtttcccgccgcggcgggccag
 E  R  D  G  A  E  A  A  Q  L  Y  V  K  F  P  A  A  A  G  Q ccgctgcgccagctacgcgggttcgagaaggtgcatctggccaagggcgcggagcagaag
 P  L  R  Q  L  R  G  F  E  K  V  H  L  A  K  G  A  E  Q  K gtgaagttcgagctgcgcaggagggatctgagttattgggatgtcgaggcgcagaattgg
 V  K  F  E  L  R  R  R  D  L  S  Y  W  D  V  E  A  Q  N  W gcggttgcgaggggcacgtatgagttcttcgtcggcgcgagtagtagggacttgaaggcg
 A  V  A  R  G  T  Y  E  F  F  V  G  A  S  S  R  D  L  K  A cacgcgattctaaccgtttga
 H  A  I  L  T  V  -
```

-continued

SEQ ID NO: 90
LENGTH: 786
TYPE: PRT
ORGANISM: M. phaseolina
MRPSLSVLPALTLLVRGLSAYSTNYTSQNLASGTIKLGDWQDAYDRAKTFVDGLSNSEKISLITGSDVSNFTA

LYFRDSGDSILQYYFVTTWPLSSALAMTWDKKMMYQMYKALGDEFYAKGINVANGPVSQPLGRSPWGGRNGES

FGPDSYLNGIAFGLSVKGYGDAGVISGAKHFLLNEQENNRTQDSTGGGGGSPPNDGGNPTTPGSGAAPTGGM

GGGASSDSSSSESIAYSSQVDDKTLHETYMWPFFDGVKAGLGAVMCALNRVNETYACENQDLIAGKLKSEIGF

PGFVFGDVGGQKTAFGSANAGMDYGSSSTWSNSTMLAGLNNGSLTEARLTDMAVRNVLPSYKFNQQDGTYPTT

AGLEDYVDPRANHSKIARSIAASSLVLLKNENNALPLKKPKSMSIFGVHAGAAIAGPNDPISVTGSDDIYQGH

AASLGGSGTGSFPYLVTPHYALTTKVIEDGTMFRWIMNDTGYTSTSGGLSGYSSGTGAAHTYSGYATDSEVCI

VFLNAYSGEGADRSALYNTDQDGMVASVASACNNTIVVINAVAARLVDAWIDNVNITAVVYGSMLGQESGHAI

VDVLYGAVNPSGKLTYTIAKNESDYNTGLCTDLICDFSEGNYIDYKYFDAYNVTPRYEFGYGLSYTTFKYADT

LSVAKTNGSALARTYATGPLAVGGREDLWDVVATAETSIANTGERDGAEAAQLYVKFPAAAGQPLRQLRGFEK

VHLAKGAEQKVKFELRRRDLSYWDVEAQNWAVARGTYEFFVGASSRDLKAHAILTV*

SEQ ID NO: 91
LENGTH: 2205 (including 150 bp 5' UTR and 150 bp 3' UTR)
TYPE: DNA
ORGANISM: M. phaseolina
TTTACCGACGCTGGGGGCTCGGGTAATCCGCGAAGGCACGTTTACTATGCATATAAAGACGGCTGCCGGCATT

GGTTCAACATGTGCTGCAGAGCTTTTGGACGCAGGCCAGGTCTCTCTTAACCCACCGCTGCCAGTCACTGCTC

CAAGATGCGGACACCCGTTCTCCACACCTCAACTACCAAGCCGCAGGGCTCATGGGCTTCCATCTTTGTGGCA

GCCCTGGCCTCGATCTCTGCTGTCTCAGCAAGAGCATTACCCAGGGGCGCTGCTCAGAACGAGACCGTCCCGG

CCTACCGCAACCCTACCCTCTGCATCGATGAGCGTCTGGACGACTTGATCCAGCGCATGACCCTGGAGGAGAA

GGCAGGACAGCTTTTCATTAAGCAGATTCCCATGGGAACGAATGGCACGATCGACATCGAGACAAAAACCGAC

AACTACACTTCCGCCGACCTCATCAGCCAGAAGCTCATGTCCCACTTCAACCTGCAATCCAGCGGCAAGGCCA

GCGACATTGCAAACTGGCACAACAGCATCCAGGAGCTGGCTCTGCAGACTCGGCTCGGAATACCGATCACGAT

AGCCACGGACCCGCGCCACTCCTTCGCCGAAACCGCAGGATCCGCTGTCGGCGTCGGTTCATTCTCGCAATGG

CCCGAGACGCTGGGCTTGGCCGCGTTAAGGAGTCCAGAGCTTGTACAGCGCTTCGCTGAGATTGCGCGTGAGG

AGTACATGGCCGTCGGCATCCGGTCTGCGCTTAGCCCGCAGATCGATGTCACCACGGAGCCGCGCTGGGCACG

CTCCGGACAGACGTACGGAGAAGACGCAAACCTGACCAGCTCCCTGGTTGTTGGTTACCTCAAGGGCTTCCAG

GGCGAGACTCTTGGCCGCCACTCCGTCACCACGGTCACGAAGCATTTCCCCGGCGGTGGGCCTGGCCAAAATG

GCAATGACTCGCACTTCGAGACTGGAAAGAACAATGTCTACCCCGGAGGCTACTTTGACTACCACCTGGAGCC

GTTCAGAGCTGCCATCGCTGCCGGTGCTAGACAGATGATGCCTTCCTATGCCCGGCCGATCGGAACCAAGTAT

GAGGAGGTCGCCATGGGCTTTAACAAGGGCATCGTAACAGATCTCCTGCGCGACGAACTCGGCTTCGACGGCA

TCGTCGTTAGCGATTGGGGTCTAGTCACTAACTTCACCGCGCGCGGCGAGGAGATGGAGGCCATCTCGTGGGG

CGTGGAGAACCTGAGCGAAATCGAAAAGGTTGAGAAGATCCTCAACGCCGGCGTCGACCAGCTCGGCGGCGAG

ATCCGGACTGAGCTTGTCATCCAGCTCGTCAACGAGGGTGCCATCTCAGAGGAGCGCATCGACGTCTCGGTGC

GCCGGCTGCTGCGCGAGAAGTTCGTGCTCGGCCTCTTCGACAACCCCTTCGTCGACCCGGATGCGGCTGACGC

TATCGTCGGCAATGATTACTTCCGCCGCGTCGGCAACGAGACTCAGCGCCGCGCCTACACCCTGCTCAAGAAT

GACGACGACCTCCTGCCTCTGACGCTCGACGCCGACACCAAGTTCTATGCCGACGGCTTCAACGCATCGTACC

TGCTCGAGCGCGGCCTCGCCGTCGTCGACACCCCTGAGGAGGCCGACTACGCGTTCCTGCGCCTCTCCACCCC

CTATGAGGCCCGTGGTGGCGGCTTCGAGCGCAACTACCATCAAGGACGCCTCGATTTCAACGAGACTGAGAAG

GCTCGCCACGCCGCCATCACGCAAACCGTCCCGACCATCGTTGACATCTACCTCGACCGCCCAGCCGTCATCC

CCGAGCTCGCCGAGGACTCGGCCGCGCTGCTCGGCAACTACGGCGCCAGCGTTGATGCGTTCCTGGATATCGT

-continued

```
GTTCGGCACGGAGGGTTGGAAGCCCGAGGGCAAGCTGCCGTTCGATCTGCCCAGGTCGATGGAGGCGGTGGAG

GCGAATAAGGAAGATGTGCCCTTTGATACTGAGAATCCCGTGTTCCGGTATGGGCATGGGTTAAGCTATGCGG

AGAAGTGTTGAACGTGAAGGAGTTGATGACTTAACGTAATGTAACGAGCAAAAATTTTTTTATCAGAAATCAG

ACCTTTTGTTCGCGATTGGGGGCTCGAAATGCCACCATATCACACTAACGCTACATTCAGAATGAATTTGTGC

GACGATAAAACATGC
```

```
SEQ ID NO: 92
LENGTH: 1905
TYPE: DNA
ORGANISM: M. phaseolina
FEATURE NAME/KEY: CDS
LOCATION: (1)...(1905)
atgcggacacccgttctccacacctcaactaccaagccgcagggctcatgggcttccatc
 M   R   T   P   V   L   H   T   S   T   T   K   P   Q   G   S   W   A   S   I tttgtggcagccctggcctcgatctctgctgtctcagcaagagcattacccaggggcgct
 F   V   A   A   L   A   S   I   S   A   V   S   A   R   A   L   P   R   G   A gctcagaacgagaccgtcccggcctaccgcaaccctaccctctgcatcgatgagcgtctg
 A   Q   N   E   T   V   P   A   Y   R   N   P   T   L   C   I   D   E   R   L gacgacttgatccagcgcatgaccctggaggagaaggcaggacagcttttcattaagcag
 D   D   L   I   Q   R   M   T   L   E   E   K   A   G   Q   L   F   I   K   Q attcccatgggaacgaatggcacgatcgacatcgagacaaaaaccgacaactacacttcc
 I   P   M   G   T   N   G   T   I   D   I   E   T   K   T   D   N   Y   T   S gccgacctcatcagccagaagctcatgtcccacttcaacctgcaatccagcggcaaggcc
 A   D   L   I   S   Q   K   L   M   S   H   F   N   L   Q   S   S   G   K   A agcgacattgcaaactggcacaacagcatccaggagctggctctgcagactcggctcgga
 S   D   I   A   N   W   H   N   S   I   Q   E   L   A   L   Q   T   R   L   G ataccgatcacgatagccacggacccgcgccactccttcgccgaaaccgcaggatccgct
 I   P   I   T   I   A   T   D   P   R   H   S   F   A   E   T   A   G   S   A gtcggcgtcggttcattctcgcaatggcccgagacgctgggcttggccgcgttaaggagt
 V   G   V   G   S   F   S   Q   W   P   E   T   L   G   L   A   A   L   R   S ccagagcttgtacagcgcttcgctgagattgcgcgtgaggagtacatggccgtcggcatc
 P   E   L   V   Q   R   F   A   E   I   A   R   E   E   Y   M   A   V   G   I cggtctgcgcttagcccgcagatcgatgtcaccacggagccgcgctgggcacgctccgga
 R   S   A   L   S   P   Q   I   D   V   T   T   E   P   R   W   A   R   S   G cagacgtacggagaagacgcaaacctgaccagctccctggttgttggttacctcaagggc
 Q   T   Y   G   E   D   A   N   L   T   S   S   L   V   V   G   Y   L   K   G ttccagggcgagactcttggccgccactccgtcaccacggtcacgaagcatttccccggc
 F   Q   G   E   T   L   G   R   H   S   V   T   T   V   T   K   H   F   P   G ggtgggcctggccaaaatggcaatgactcgcacttcgagactggaaagaacaatgtctac
 G   G   P   G   Q   N   G   N   D   S   H   F   E   T   G   K   N   N   V   Y cccggaggctactttgactaccacctggagccgttcagagctgccatcgctgccggtgct
 P   G   G   Y   F   D   Y   H   L   E   P   F   R   A   A   I   A   A   G   A agacagatgatgccttcctatgcccggccgatcggaaccaagtatgaggaggtcgccatg
 R   Q   M   M   P   S   Y   A   R   P   I   G   T   K   Y   E   E   V   A   M ggctttaacaagggcatcgtaacagatctcctgcgcgacgaactcggcttcgacggcatc
 G   F   N   K   G   I   V   T   D   L   L   R   D   E   L   G   F   D   G   I gtcgttagcgattggggtctagtcactaacttcaccgcgcgcggcgaggagatggaggcc
 V   V   S   D   W   G   L   V   T   N   F   T   A   R   G   E   E   M   E   A atctcgtggggcgtggagaacctgagcgaaatcgaaaaggttgagaagatcctcaacgcc
 I   S   W   G   V   E   N   L   S   E   I   E   K   V   E   K   I   L   N   A ggcgtcgaccagctcggcggcgagatccggactgagcttgtcatccagctcgtcaacgag
 G   V   D   Q   L   G   G   E   I   R   T   E   L   V   I   Q   L   V   N   E ggtgccatctcagaggagcgcatcgacgtctcggtgcgccggctgctgcgcgagaagttc
 G   A   I   S   E   E   R   I   D   V   S   V   R   R   L   L   R   E   K   F gtgctcggcctcttcgacaacccttcgtcgacccggatgcggctgacgctatcgtcggc
 V   L   G   L   F   D   N   P   F   V   D   P   D   A   A   D   A   I   V   G
```

-continued

```
aatgattacttccgccgcgtcggcaacgagactcagcgccgcgcctacaccctgctcaag
 N  D  Y  F  R  R  V  G  N  E  T  Q  R  R  A  Y  T  L  L  K aatgacgacgacctcctgcctctgacgctcgacgccgacaccaagttctatgccgacggc
 N  D  D  D  L  L  P  L  T  L  D  A  D  T  K  F  Y  A  D  G ttcaacgcatcgtacctgctcgagcgcggcctcgccgtcgtcgacacccctgaggaggcc
 F  N  A  S  Y  L  L  E  R  G  L  A  V  V  D  T  P  E  E  A gactacgcgttcctgcgcctctccacccccctatgaggcccgtggtggcggcttcgagcgc
 D  Y  A  F  L  R  L  S  T  P  Y  E  A  R  G  G  G  F  E  R aactaccatcaaggacgcctcgatttcaacgagactgagaaggctcgccacgccgccatc
 N  Y  H  Q  G  R  L  D  F  N  E  T  E  K  A  R  H  A  A  I acgcaaaccgtcccgaccatcgttgacatctacctcgaccgcccagccgtcatccccgag
 T  Q  T  V  P  T  I  V  D  I  Y  L  D  R  P  A  V  I  P  E ctcgccgaggactcggccgcgctgctcggcaactacggcgccagcgttgatgcgttcctg
 L  A  E  D  S  A  A  L  L  G  N  Y  G  A  S  V  D  A  F  L gatatcgtgttcggcacggagggttggaagcccgagggcaagctgccgttcgatctgccc
 D  I  V  F  G  T  E  G  W  K  P  E  G  K  L  P  F  D  L  P aggtcgatggaggcggtggaggcgaataaggaagatgtgccctttgatactgagaatccc
 R  S  M  E  A  V  E  A  N  K  E  D  V  P  F  D  T  E  N  P gtgttccggtatgggcatgggttaagctatgcggagaagtgttga
 V  F  R  Y  G  H  G  L  S  Y  A  E  K  C  -
```

SEQ ID NO: 93
LENGTH: 634
TYPE: PRT
ORGANISM: *M. phaseolina*
MRTPVLHTSTTKPQGSWASIFVAALASISAVSARALPRGAAQNETVPAYRNPTLCIDERLDDLIQRMTLEEKA

GQLFIKQIPMGTNGTIDIETKTDNYTSADLISQKLMSHFNLQSSGKASDIANWHNSIQELALQTRLGIPITIA

TDPRHSFAETAGSAVGVGSFSQWPETLGLAALRSPELVQRFAEIAREEYMAVGIRSALSPQIDVTTEPRWARS

GQTYGEDANLTSSLVVGYLKGFQGETLGRHSVTTVTKHFPGGGPGQNGNDSHFETGKNNVYPGGYFDYHLEPF

RAAIAAGARQMMPSYARPIGTKYEEVAMGFNKGIVTDLLRDELGFDGIVVSDWGLVTNFTARGEEMEAISWGV

ENLSEIEKVEKILNAGVDQLGGEIRTELVIQLVNEGAISEERIDVSVRRLLREKFVLGLFDNPFVDPDAADAI

VGNDYFRRVGNETQRRAYTLLKNDDDLLPLTLDADTKFYADGFNASYLLERGLAVVDTPEEADYAFLRLSTPY

EARGGGFERNYHQGRLDFNETEKARHAAITQTVPTIVDIYLDRPAVIPELAEDSAALLGNYGASVDAFLDIVF

GTEGWKPEGKLPFDLPRSMEAVEANKEDVPFDTENPVFRYGHGLSYAEKC*

SEQ ID NO: 94
LENGTH: 2271 (including 150 bp 5' UTR and 150 bp 3' UTR)
TYPE: DNA
ORGANISM: *M. phaseolina*
CTCTGGGCAAGGGACAGGGAATGCATTTAGGCCGATATTGGGGGACTCGCCTCTCTCACATAAATATGCCTTC

CGCCCGCCTCCATCAGGGCCTCAGGGACCCACGGACTCCGCTCACCAGGCCTCAATCCCCGCACGCACGAGTT

CGCCATGTCCTCCTCCCTCGTCCTCCCGGTGCTTCTGGCCTCGACCTCCTTGGTCGGAGCCCAATTGACTTTT

GGCACCCCGGCcGGCAATTACTCCACCAAGACATACTCCGTCCCCGCCATCGAGACTGAGTACCGCCCCAACA

CCGACTACTCGGACAAGGCCCTCGCCTTCCTGTGGGACCAGGTCGGCCCTATCTCCACCGGCCCCGTGACTAC

GACTGTCGAGCCCACGCCGGAGCCCAGTCTGTATCCTCAGCCAGGCCCCATCCACCCGCTCATTCCCAGCTAT

GATCGGAACTTGACTGGTCTGAAGCTGCCCAAGGGCTTCAAGTGGGGAGTCTCGTCCTCTTCATACCAGATAG

AGGGAGCGGCCGATGCAGAAGGTAAAGGTCCGTCCATTTGGGACTTGCTCTCCCATCGCGTCCCCAATTTCGT

TGCGGACAACACGACGGGAGATGTTGTGGCGAGCCACTACTGGTTGTACAAGCAGGACTTTGCCCGGCTCAAG

GCACTGGGCATCCCCGCATTCAGCCCCAGTATCAGCTGGCCGCGTCTGTTCCCGTTCGGCAAGGGCCCTGTAA

ACCAGCAGGCCGTGGCCCATTACGATGATGTTATATCTGAGCTAGTGAAGAACGGGATCAAGCCCAAGATTAC

GCTCTTCCACTGGGATACGCCGCTGGCGCTCTTCAATGAGTACGGCGCGTGGACTTCGAGGAACGTTGTTGAT

GATTTCGTCAACTATGCAAAGTTTGTCATTTCTCGGTACGATGCGTACGTTGAGGATTGGTTCACTATCAATG

```
AGCCGCAATACTGCGATTGGCAATACTCTCTACCCTGCGGGCGAAGTAAGTTAAAGGCCCTCCGCACCAGC

CGCGTCCCCGCCCGAACCCCTCACCACCACACCCACAGCATCACTGCTACATCATTGTTTCAGAAGCAGCAGT

TACGGCTCCCTAACAACGTCCAGTATTATCCTGCTTATCAGAATTATACCGGAGGGTTGCCGACGCGCTTTAT

TTGCGGTCATTACACCCTTCTGGCGCACGCGAAGGTGGTTGACTGGTAAGTTTAGCTCTCCCCTGAACGGTGG

AATACAAAGATGGCTGACACATGTGGACCTGAAAAGGTATAGAAACGAATTCAAGGTGCcTACGATCTGTGAA

AGTCCATATGCGTTGCTAATAACTAACACTCCATAGGGCACCGGCAAAATCACATTCAAGAACTCGGGCAACT

ACTTCCAGCCCAATACTTCCTCCGAGGCAGATGCCATTGCTACGCAGCGTAACTACGACTTCGTTCTCGGCTG

GTTTGGTGGTCCATGGACGGACGGTGATTATCCTCAATCCCTAAAGGACACCCTGGGGGATATCCTTCCAGAG

TTTACGCAAGAAGAAAAAGACCTCATCAAGGGCTCCTGCGACTACTTCGCAATCGACGGATATTCCTCGTTCA

CTGCGTACGCTCTTCCGCAGGAGGAGTACGAGAACTGTATCACCAACTCCTCTCACCCGTCCTACCCAACTTG

CGCCGGAAGCGTTGGCCTGGCGACTGACGGCTTCCCGCTCGCCCCGGCCGCCGACCAAGGTGTCTCATGGCTC

ATCGATGCCCCTCAAGGCCTACGCCGCTTCCTTTCTAAAATTACCAAGGAGCTCTTCCCGTCGGTCAACGAGA

TTGCCGTCACCGAGTTCGGTTTCGCCGAGCCCTTCGAATCCCAGCTCGACAGCCTGCAAACCATCCTCTGGGA

TCTGCGCCGCGCCGACTACTTCCAGTCGTACCTAGACGCCATCTTGCAAGCCATTCATTATGATGGCGTCAAT

GTGACTGGCGCCTGGGGCTGGGCCATCTTCGATAACTTTGAGTGGCTTGTCGGCCTCGGCACTCGCTTCGGTC

TGCAGTATGTGAATTACACTGACTTGACGAGGACGCCCAAAGCTAGCGTATTCCAGTTTGTGAACTGGTTCAA

GTAAGTCTCCATATCATTGACGTTTTGTAGTGCACGAACATGAACTGACTTTTTGTATTAGAGAGCATGAGGA

TCTGGACGAGCCGTCCAATACCACTATGAGGTTGTTCTAGAGAGAGAGAGAGAGTCCTCGTATTAGAGTAGCG

TATGGAAC

SEQ ID NO: 95
LENGTH: 1731
TYPE: DNA
ORGANISM: M. phaseolina
FEATURE NAME/KEY: CDS
LOCATION: (1)...(1731)
atgtcctcctccctcgtcctcccggtgcttctggcctcgacctccttggtcggagcccaa
 M  S  S  S  L  V  L  P  V  L  L  A  S  T  S  L  V  G  A  Q ttgacttttggcaccccggccggcaattactccaccaagacatactccgtccccgccatc
 L  T  F  G  T  P  A  G  N  Y  S  T  K  T  Y  S  V  P  A  I gagactgagtaccgccccaacaccgactactcggacaaggccctcgccttcctgtgggac
 E  T  E  Y  R  P  N  T  D  Y  S  D  K  A  L  A  F  L  W  D caggtcggccctatctccaccggccccgtgactacgactgtcgagcccacgccggagccc
 Q  V  G  P  I  S  T  G  P  V  T  T  T  V  E  P  T  P  E  P agtctgtatcctcagccaggccccatccaccegctcattcccagctatgatcggaacttg
 S  L  Y  P  Q  P  G  P  I  H  P  L  I  P  S  Y  D  R  N  L actggtctgaagctgcccaagggcttcaagtggggagtctcgtcctcttcataccagata
 T  G  L  K  L  P  K  G  F  K  W  G  V  S  S  S  S  Y  Q  I gagggagcggccgatgcagaaggtaaaggtccgtccatttgggacttgctctcccatcgc
 E  G  A  A  D  A  E  G  K  G  P  S  I  W  D  L  L  S  H  R gtccccaatttcgttgcggacaacacgacgggagatgttgtggcgagccactactggttg
 V  P  N  F  V  A  D  N  T  T  G  D  V  V  A  S  H  Y  W  L tacaagcaggactttgcccggctcaaggcactgggcatcccgcattcagcccagtatc
 Y  K  Q  D  F  A  R  L  K  A  L  G  I  P  A  F  S  P  S  I agctggccgcgtctgttcccgttcggcaagggccctgtaaaccagcaggccgtggcccat
 S  W  P  R  L  F  P  F  G  K  G  P  V  N  Q  Q  A  V  A  H tacgatgatgttatatctgagctagtgaagaacgggatcaagcccaagattacgcttctc
 Y  D  D  V  I  S  E  L  V  K  N  G  I  K  P  K  I  T  L  F cactgggatacgccgctggcgctcttcaatgagtacggcgcgtggacttcgaggaacgtt
 H  W  D  T  P  L  A  L  F  N  E  Y  G  A  W  T  S  R  N  V
```

```
gttgatgatttcgtcaactatgcaaagtttgtcatttctcggtacgatgcgtacgttgag
 V  D  D  F  V  N  Y  A  K  F  V  I  S  R  Y  D  A  Y  V  E gattggttcactatcaatgagccgcaatactgcgattggcaatactctctaccctgcg
 D  W  F  T  I  N  E  P  Q  Y  C  D  W  Q  Y  S  L  Y  P  A ggcgaatattatcctgcttatcagaattataccggagggttgccgacgcgctttatttgc
 G  E  Y  Y  P  A  Y  Q  N  Y  T  G  G  L  P  T  R  F  I  C ggtcattacacccttctggcgcacgcgaaggtggttgactggtatagaaacgaattcaag
 G  H  Y  T  L  L  A  H  A  K  V  V  D  W  Y  R  N  E  F  K ggcaccggcaaaatcacattcaagaactcgggcaactacttccagcccaatacttcctcc
 G  T  G  K  I  T  F  K  N  S  G  N  Y  F  Q  P  N  T  S  S gaggcagatgccattgctacgcagcgtaactacgacttcgttctcggctggtttggtggt
 E  A  D  A  I  A  T  Q  R  N  Y  D  F  V  L  G  W  F  G  G ccatggacggacggtgattatcctcaatccctaaaggacacccctggggatatccttcca
 P  W  T  D  G  D  Y  P  Q  S  L  K  D  T  L  G  D  I  L  P gagtttacgcaagaagaaaaagacctcatcaagggctcctgcgactacttcgcaatcgac
 E  F  T  Q  E  E  K  D  L  I  K  G  S  C  D  Y  F  A  I  D ggatattcctcgttcactgcgtacgctcttccgcaggaggagtacgagaactgtatcacc
 G  Y  S  S  F  T  A  Y  A  L  P  Q  E  E  Y  E  N  C  I  T aactcctctcacccgtcctacccaacttgcgccgaagcgttggcctggcgactgacggc
 N  S  S  H  P  S  Y  P  T  C  A  G  S  V  G  L  A  T  D  G ttcccgctcgccccggccgccgaccaaggtgtctcatggctcatcgatgcccctcaaggc
 F  P  L  A  P  A  A  D  Q  G  V  S  W  L  I  D  A  P  Q  G ctacgccgcttcctttctaaaattaccaaggagctcttcccgtcggtcaacgagattgcc
 L  R  R  F  L  S  K  I  T  K  E  L  F  P  S  V  N  E  I  A gtcaccgagttcggttttcgccgagcccttcgaatcccagctcgacagcctgcaaaccatc
 V  T  E  F  G  F  A  E  P  F  E  S  Q  L  D  S  L  Q  T  I ctctgggatctgcgccgcgccgactacttccagtcgtacctagacgccatcttgcaagcc
 L  W  D  L  R  R  A  D  Y  F  Q  S  Y  L  D  A  I  L  Q  A attcattatgatggcgtcaatgtgactggcgcctggggctgggccatcttcgataactt
 I  H  Y  D  G  V  N  V  T  G  A  W  G  W  A  I  F  D  N  F gagtggcttgtcggcctcggcactcgcttcggtctgcagtatgtgaattacactgacttg
 E  W  L  V  G  L  G  T  R  F  G  L  Q  Y  V  N  Y  T  D  L acgaggacgcccaaagctagcgtattccagtttgtgaactggttcaagtaa
 T  R  T  P  K  A  S  V  F  Q  F  V  N  W  F  K  -
```

SEQ ID NO: 96
LENGTH: 576
TYPE: PRT
ORGANISM: M. phaseolina
MSSSLVLPVLLASTSLVGAQLTFGTPAGNYSTKTYSVPAIETEYRPNTDYSDKALAFLWDQVGPISTGPVTTT

VEPTPEPSLYPQPGPIHPLIPSYDRNLTGLKLPKGFKWGVSSSSYQIEGAADAEGKGPSIWDLLSHRVPNFVA

DNTTGDVVASHYWLYKQDFARLKALGIPAFSPSISWPRLFPFGKGPVNQQAVAHYDDVISELVKNGIKPKITL

FHWDTPLALFNEYGAWTSRNVVDDFVNYAKFVISRYDAYVEDWFTINEPQYCDWQYSLYPAGEYYPAYQNYTG

GLPTRFICGHYTLLAHAKVVDWYRNEFKGTGKITFKNSGNYFQPNTSSEADAIATQRNYDFVLGWFGGPWTDG

DYPQSLKDTLGDILPEFTQEEKDLIKGSCDYFAIDGYSSFTAYALPQEEYENCITNSSHPSYPTCAGSVGLAT

DGFPLAPAADQGVSWLIDAPQGLRRFLSKITKELFPSVNEIAVTEFGFAEPFESQLDSLQTILWDLRRADYFQ

SYLDAILQAIHYDGVNVTGAWGWAIFDNFEWLVGLGTRFGLQYVNYTDLTRTPKASVFQFVNWFK*

SEQ ID NO: 97
LENGTH: 2298 (including 150 bp 5' UTR and 150 bp 3' UTR)
TYPE: DNA
ORGANISM: M. phaseolina
AGCGCCGCATAAGAAGCGCCAGCGCCCGCCTCGCCTCTGCTCACATCTTCCGTGAAACCTGGCCTTTGGAGCA

TCACTGGAAAAGTACCAGTGCGACACTAGTGGCACGAACATTTTTCAGCAACGAGGACAGAACGAGAGACAAC

CGAGATGGCAGAGGCAGTACTTCCGAAGGATTTCCTCTGGGGCTTTGCAACAGCAAGGTCTGCTCCCCTTTCT

-continued

CCTGAAAGCTTCCTCCTTATGATGTCGTTGTTCCTGCGTCGGCAGCCGGAGAGAGAGATAAGCTTACCTTCAT
TTACTTACACTCCCTAGCTACCAAATCGAAGGTGCTCCGAACGAGGACGGCCGTGCTGATAGCATCTGGGATA
CCTTCTGCCGCAAGCCCGGCAAGATCGCCGACGCCAGCAGCGGCGATGTTGCCTGCGACTCGTACCACCGAAC
TGCTGAAGACATTGCCCTCCTAAAGCAGTGTCGCGCCAAAGCCTATCGCTTCTCCCTCTCCTGGTCCCGGATT
ATCCCCTTGGGCGGCCGGAATGATCCAGTCAACGAAAAGGGCCTCCAGCACTACGTGAAACTTGCCGACGACC
TGATTGCCGCCGGTATCACGCCGATGGTGACTCTGTACCACTGGGACCTTCCGGACGAGTTGGACAAGCGGTA
CGGTGGACTTCTGAATAAGGAGGAATTTGTGGCCGACTACGTTCACTACGCTAGGGTCGTGTTCAAAGCGTTT
GGCAGCAGGGTCAAGTACTGGATCACCTTCAACGAGCCATGGTGCAGCTCGATCCTCGGCTACAGCACCGGCC
TGTTCGCGCCGGGCAGGACGAGTAACCGCAGCAAGAATCCCGAGGGAGACAGTTCGAGGGAGCCATGGATCGT
CGGACACAATCTCCTGATTGCCCATGCTTCGGCCGTCAAGGTGTATCGAGAAGAGTTCAAGGCGAAGGACGGT
GGTCAGATTGGCATCACTCTGAACGGTGAGCTGAAACTTCCAAAAATACTTCAAACACCACGTACTAGCAAGC
GGGATTGCACTAAGGGGTGAGATGAACCTTGTGCTGCCGATCATTCGCCTGGACCTTCGGTCAGACTCGGGTT
GGACACTGCGTGCCGTCGCTGTGGCCGGGTGCTTCGGGCCTATACAAAGCTAGTCTGGACGACATGTTCTTTT
GAGTTTGGAAGTCGACAGGCCCGTTCCCGCGTGCATCCCTTCTTGTCTCATGGTGTGATCAGATGCAGCTCGA
CCATCGCTAACATGTCCGGCAGGGGATTACATGTATCCTTGGGACCCTGAAGACCCGCGTGATGTCGAAGCTG
CCAACCGCAAGCATGAGTTCTCCATCTCCTGGTTTGCGGATCCAGTCTACTTCGGCAAGTATCCTGACAGCAT
GCGCAAGCAGCTTGGCGACCGTCTGCCGGAATTCACCGCGGACGAAGCAGCGCTGATCAAGGGTAGCAACGAT
TTCTACGGCATGAACCACTATACCGCAAACTACGTGAAGCACGTCGACACAGAGCCCGCCGAGGACGATTTCC
TTGGAAACCTCGAGTGCACCTTCTACAGCAAGAAAGGCGAGTGCATCGGCCCAGAGACACAGAGCCCATGGCT
CAGGCCGAACGGGCTGGGGTTCAGGAAGCTGCTGAAATGGATAAGGTTCGTTTCGCCGGAAACTCTATTGGGC
CTGGTTCCGCGACGGGAGGGAAAGCCGCGCTTGGGAAACCACTAACATCTGTGACATCAGTGACCGCTACGGA
CGTCCTACCATCTACGTTACGGAGAACGGAACGAGCCTGAAGGGGGAGAACGACCTTCCTCTGGAACAGCTGC
TGGAAGATGATTTCCGGGTCAAGTACTTCGACGACTACATCCATGCGCTCGCGGATGCGTACAGCAAGGACAA
TGTCGACGTTCGAGGCTACATGGCTTGGTCACTCATGGAGTAAGCAACGCCCAGTGTTGACGCACAGTGCCAT
CCGGTGGGATTCCGCGAGGCTGACCAAACTCCCCGCAGTAATTTCGAGTGGGCGGAGGGATACGAGACGCGCT
TTGGCGTGTGCTACGTCGACTACAAAGGGGGCCAAAAGCGATATCCCAAGAAGAGCGCCAGGGCTATTGGTGA
GATCTTCGATGCGCTGATGAGGAAGGACTAGCTTGGGCGGATGGCGATTGGCCAAATGAGATTGCGAGCAGGT
TTTCGGCGGACGTTCCATCGGGGCAGGGCAGGGGAAAAGGGGGCCATGCTGGCACGGCAAATGTCAGTAGCGC
ATGTCGACTGCCGTGCCGGGAGTTGAAGACGTCAA

```
SEQ ID NO: 98
LENGTH: 1443
TYPE: DNA
ORGANISM: M. phaseolina
FEATURE NAME/KEY: CDS
LOCATION: (1)...(1443)
atggcagaggcagtacttccgaaggatttcctctggggctttgcaacagcaagctaccaa
 M   A   E   A   V   L   P   K   D   F   L   W   G   F   A   T   A   S   Y   Q atcgaaggtgctccgaacgaggacggccgtgctgatagcatctgggataccttctgccgc
 I   E   G   A   P   N   E   D   G   R   A   D   S   I   W   D   T   F   C   R aagcccggcaagatcgccgacgccagcagcggcgatgttgcctgcgactcgtaccaccga
 K   P   G   K   I   A   D   A   S   S   G   D   V   A   C   D   S   Y   H   R actgctgaagacattgccctcctaaagcagtgtcgcgccaaagcctatcgcttctccctc
 T   A   E   D   I   A   L   L   K   Q   C   R   A   K   A   Y   R   F   S   L tcctggtcccggattatccccttgggcggccggaatgatccagtcaacgaaaagggcctc
 S   W   S   R   I   I   P   L   G   G   R   N   D   P   V   N   E   K   G   L cagcactacgtgaaacttgccgacgacctgattgccgccggtatcacgccgatggtgact
 Q   H   Y   V   K   L   A   D   D   L   I   A   A   G   I   T   P   M   V   T
```

```
ctgtaccactgggaccttccggacgagttggacaagcggtacggtggacttctgaataag
 L  Y  H  W  D  L  P  D  E  L  D  K  R  Y  G  G  L  L  N  K gaggaatttgtggccgactacgttcactacgctagggtcgtgttcaaagcgtttggcagc
 E  E  F  V  A  D  Y  V  H  Y  A  R  V  V  F  K  A  F  G  S agggtcaagtactggatcaccttcaacgagccatggtgcagctcgatcctcggctacagc
 R  V  K  Y  W  I  T  F  N  E  P  W  C  S  S  I  L  G  Y  S accggcctgttcgcgccgggcaggacgagtaaccgcagcaagaatcccgagggagacagt
 T  G  L  F  A  P  G  R  T  S  N  R  S  K  N  P  E  G  D  S tcgagggagccatggatcgtcggacacaatctcctgattgcccatgcttcggccgtcaag
 S  R  E  P  W  I  V  G  H  N  L  L  I  A  H  A  S  A  V  K gtgtatcgagaagagttcaaggcgaaggacggtggtcagattggcatcactctgaacggg
 V  Y  R  E  E  F  K  A  K  D  G  G  Q  I  G  I  T  L  N  G gattacatgtatccttgggaccctgaagacccgcgtgatgtcgaagctgccaaccgcaag
 D  Y  M  Y  P  W  D  P  E  D  P  R  D  V  E  A  A  N  R  K catgagttctccatctcctggtttgcggatccagtctacttcggcaagtatcctgacagc
 H  E  F  S  I  S  W  F  A  D  P  V  Y  F  G  K  Y  P  D  S atgcgcaagcagcttggcgaccgtctgccggaattcaccgcggacgaagcagcgctgatc
 M  R  K  Q  L  G  D  R  L  P  E  F  T  A  D  E  A  A  L  I aagggtagcaacgatttctacggcatgaaccactataccgcaaactacgtgaagcacgtc
 K  G  S  N  D  F  Y  G  M  N  H  Y  T  A  N  Y  V  K  H  V gacacagagcccgccgaggacgatttccttggaaacctcgagtgcaccttctacagcaag
 D  T  E  P  A  E  D  D  F  L  G  N  L  E  C  T  F  Y  S  K aaaggcgagtgcatcggcccagagacacagagcccatggctcaggccgaacgggctgggg
 K  G  E  C  I  G  P  E  T  Q  S  P  W  L  R  P  N  G  L  G ttcaggaagctgctgaaatggataagtgaccgctacggacgtcctaccatctacgttacg
 F  R  K  L  L  K  W  I  S  D  R  Y  G  R  P  T  I  Y  V  T gagaacggaacgagcctgaaggggagaacgaccttcctctggaacagctgctggaagat
 E  N  G  T  S  L  K  G  E  N  D  L  P  L  E  Q  L  L  E  D gatttccgggtcaagtacttcgacgactacatccatgcgctcgcggatgcgtacagcaag
 D  F  R  V  K  Y  F  D  D  Y  I  H  A  L  A  D  A  Y  S  K gacaatgtcgacgttcgaggctacatggcttggtcactcatggataatttcgagtgggcg
 D  N  V  D  V  R  G  Y  M  A  W  S  L  M  D  N  F  E  W  A gagggatacgagacgcgctttggcgtgtgctacgtcgactacaaaggggccaaaagcga
 E  G  Y  E  T  R  F  G  V  C  Y  V  D  Y  K  G  G  Q  K  R tatcccaagaagagcgccagggctattggtgagatcttcgatgcgctgatgaggaaggac
 Y  P  K  K  S  A  R  A  I  G  E  I  F  D  A  L  M  R  K  D tag
 -

SEQ ID NO: 99
LENGTH: 480
TYPE: PRT
ORGANISM: M. phaseolina
MAEAVLPKDFLWGFATASYQIEGAPNEDGRADSIWDTFCRKPGKIADASSGDVACDSYHRTAEDIALLKQCRA

KAYRFSLSWSRIIPLGGRNDPVNEKGLQHYVKLADDLIAAGITPMVTLYHWDLPDELDKRYGGLLNKEEFVAD

YVHYARVVFKAFGSRVKYWITFNEPWCSSILGYSTGLFAPGRTSNRSKNPEGDSSREPWIVGHNLLIAHASAV

KVYREEFKAKDGGQIGITLNGDYMYPWDPEDPRDVEAANRKHEFSISWFADPVYFGKYPDSMRKQLGDRLPEF

TADEAALIKGSNDFYGMNHYTANYVKHVDTEPAEDDFLGNLECTFYSKKGECIGPETQSPWLRPNGLGFRKLL

KWISDRYGRPTIYVTENGTSLKGENDLPLEQLLEDDFRVKYFDDYIHALADAYSKDNVDVRGYMAWSLMDNFE

WAEGYETRFGVCYVDYKGGQKRYPKKSARAIGEIFDALMRKD*
```

SEQ ID NO: 100
LENGTH: 2257 (including 150 bp 5' UTR and 150 bp 3' UTR)
TYPE: DNA
ORGANISM: M. phaseolina
TGCTCCTCGCTCATTTGCCGTGCTCGGTTTGCTCGGCGAGCACTCTATATAATGAAGTTCTTAACCGTATTTT

CTACTCTTAACTGCATCGGCGCTTATGCGCAGACGCCAGTATGGCCCATAAGCAGCTCTACCAGCTCCAATCC

GGCTATGGTTACGTCGATGGATCTGACAGTTGATGGTAAGCTGTCTGGTAGCCCTTTGCTTCACCATTCCAAG

CATTGACCCAACCCTTTGAGATCTGTGGGACATCTGGATCGGCTCTGTAGCGGTAGCTTCCATCAACACGACC

GTCTCTCCAACGCCGGTGCCAAGTGCCGAGCTGATCCCACCTCCACCGTTGCACTACCCGTCGTGGATGACAG

GACATCAGACTCCTTTGGCGCAGAAGAATGAATCTTGGAAATTTCCCAGGAATTTCTGGTGGGGCGTTGCCAG

TGCCTCGTATCAGGTTGAAGGCGCGGTCAAGGATGAAGGGCGAGCACCATCAGTGTGGGATGCCCTGCTGCAC

AATGTTGTTGACTACAGCTTGTACAATGAGACAGGTGATGTTGCCAATAACCATTATTATCTGTACAAGCAAG

GTAAGCTTACGCAGAAAAGTTGATTGTCTTGAAGAGCTGAGCACTGACTTTGTTATGCCAGACATCGCGAGGC

TTGCCGCCATGGGTGTGCCGTACTACAGCTTCTCTCTTTCCTGGTCACGAATTCTACCTTTTGGGCGCGGGCC

TGTGAACGAGGCAGGATTGGCGCATTACGAGGACGTGATTAAAACATGCTTGGAATACGGTGTCAAGCCTGCT

GTGACCCTGTAGGTTCCTCGATCCACCTACGCCCGCGGATTCACTAACGTCCTTAAGCTTCCACTGGGATCTG

CCTCTTTATCTTTACAATTTATACGGTGTGTGATCTCATCCTTGCCTGTGCTTCCCCCAAGTGGTAATTAGCT

CTCTTCAGGTGGCTGGACAAACGAACAGATAGTGGATGATTTCGTCAACTACGCACGCATCGTCTTCGAGAGA

TACGGCAACAAAGTCCCTATGTGGTTCACTGTCAATGAACCAATCAGCTTCTGGTAATACTCTGGTGCTTGGG

TACTCTGGTATTGGCTTTCCCTGACGCCGTTTCAGTACTCTGCAAATGCCCGAGCACTACTTCCGCAGAGTTC

CTATCCCGCAAAAGCAGCAGCCCTATTTCTGCGGCCAACACGTCCTCCTCGCCCATAGCAAAGTGTACCATCT

GGCCAAATCTATGAATCTGACCGGCCCCATCACACTTAAGAACAACGGTTACTACAAGACCCCTCTCACCAAC

TCAACAGACGACGCCATCGCCACGCAGCGAGCCTGGGACTTCAACGAAGGCTGGTTTGCCAATCCCGTCTTCA

TCGACGGCGAGTACCCACGGTATCTGAAAGACTACGTTGCAACCTTCCTGCGCAACCTGACCACGGAGGAAAA

AGCCGCAATCCACGGCTCGGCTGATTTCTTTGCGCACGACGCATACGCGGCGAAGTACTGCTTCCCCTCGTTC

CCATCCCTTTACGTCTGCAAGCCGCTAACGCAAAACCCGCAGGTTCTACATGGCGCCGGATGCGGGCATCGAC

GCTTGCCTGGCCAACTACTCGCACCCGCTCTTCCCCACCTGCGCCAACAGCACCTTCACGCTCGCGCCCTCCG

ACGGCGGCTGGCTGATCGGCCCCGCCGCCGACCCCTACACCTCCTGGCTGCACAAAGCGACCGACTGGATCCC

AGCCTTCATGCGCTACATCGACGCCACCTGGAAGCCTGCGGGCGGCATCGCCGTTTCCGAGTTCGGTTTCACC

GAGCCCTTCGAGCACGACAAGAAGCTCCTGGGCGACATCCGCGCTGATCTGGGCGGGTGACGTATTACAAGG

AGTACCTGGCGGCGCTGTTGCTGGCGATGAGCGAGGGAGTAAAGATTATTGGGGTGCTGGCGTGGACGATTAC

GGATAATTTGGAATGGACGGCCGGGTTCGGAGTCAAGTTCGGGCTGCAGTACGTGAATTTGACGACCCAGGAG

AGGCACTATAAGGCGAGTTTCTTTGAGTTGAAGAATATGATTGAGATGTATAAGGAGAACTAGGACGCAAAGG

AAAGTTTGTCAAAATAATGGAGAGAAAACGGTGGAAGGAATGTTTCTGGGGGCCTACCAGGCGGAAGGTATAG

AGTCTCGACCTGATGCTACTATGCAATGAAGGACTGAATGAGAGATTGATCTTATTTCGCATTTTTT

SEQ ID NO: 101
LENGTH: 1617
TYPE: DNA
ORGANISM: M. phaseolina
FEATURE NAME/KEY: CDS
LOCATION: (1)...(1617)
atggttacgtcgatggatctgacagttgatgatctgtgggacatctggatcggctctgta
 M  V  T  S  M  D  L  T  V  D  D  L  W  D  I  W  I  G  S  V gcggtagcttccatcaacacgaccgtctctccaacgccggtgccaagtgccgagctgatc
 A  V  A  S  I  N  T  T  V  S  P  T  P  V  P  S  A  E  L  I ccacctccaccgttgcactacccgtcgtggatgacaggacatcagactcctttggcgcag
 P  P  P  L  H  Y  P  S  W  M  T  G  H  Q  T  P  L  A  Q

```
aagaatgaatcttggaaatttcccaggaatttctggtggggcgttgccagtgcctcgtat
 K  N  E  S  W  K  F  P  R  N  F  W  W  G  V  A  S  A  S  Y caggttgaaggcgcggtcaaggatgaagggcgagcaccatcagtgtgggatgccctgctg
 Q  V  E  G  A  V  K  D  E  G  R  A  P  S  V  W  D  A  L  L cacaatgttgttgactacagcttgtacaatgagacaggtgatgttgccaataaccattat
 H  N  V  V  D  Y  S  L  Y  N  E  T  G  D  V  A  N  N  H  Y tatctgtacaagcaagacatcgcgaggcttgccgccatgggtgtgccgtactacagcttc
 Y  L  Y  K  Q  D  I  A  R  L  A  A  M  G  V  P  Y  Y  S  F tctctttcctggtcacgaattctacctttgggcgcgggcctgtgaacgaggcaggattg
 S  L  S  W  S  R  I  L  P  F  G  R  G  P  V  N  E  A  G  L gcgcattacgaggacgtgattaaaacatgcttggaatacggtgtcaagcctgctgtgacc
 A  H  Y  E  D  V  I  K  T  C  L  E  Y  G  V  K  P  A  V  T ctcttccactgggatctgcctctttatctttacaatttatacggtggctggacaaacgaa
 L  F  H  W  D  L  P  L  Y  L  Y  N  L  Y  G  G  W  T  N  E cagatagtggatgatttcgtcaactacgcacgcatcgtcttcgagagatacggcaacaaa
 Q  I  V  D  D  F  V  N  Y  A  R  I  V  F  E  R  Y  G  N  K gtccctatgtggttcactgtcaatgaaccaatcagcttctgtactctgcaaatgcccgag
 V  P  M  W  F  T  V  N  E  P  I  S  F  C  T  L  Q  M  P  E cactacttccgcagagttcctatcccgcaaaagcagcagccctatttctgcggccaacac
 H  Y  F  R  R  V  P  I  P  Q  K  Q  Q  P  Y  F  C  G  Q  H gtcctcctcgcccatagcaaagtgtaccatctggccaaatctatgaatctgaccggcccc
 V  L  L  A  H  S  K  V  Y  H  L  A  K  S  M  N  L  T  G  P atcacacttaagaacaacggttactacaagacccctctcaccaactcaacagacgacgcc
 I  T  L  K  N  N  G  Y  Y  K  T  P  L  T  N  S  T  D  D  A atcgccacgcagcgagcctgggacttcaacgaaggctggtttgccaatcccgtcttcatc
 I  A  T  Q  R  A  W  D  F  N  E  G  W  F  A  N  P  V  F  I gacggcgagtacccacggtatctgaaagactacgttgcaaccttcctgcgcaacctgacc
 D  G  E  Y  P  R  Y  L  K  D  Y  V  A  T  F  L  R  N  L  T acggaggaaaaagccgcaatccacggctcggctgatttctttgcgcacgacgcatacgcg
 T  E  E  K  A  A  I  H  G  S  A  D  F  F  A  H  D  A  Y  A gcgaagttctacatggcgccggatgcgggcatcgacgcttgcctggccaactactcgcac
 A  K  F  Y  M  A  P  D  A  G  I  D  A  C  L  A  N  Y  S  H ccgctcttccccacctgcgccaacagcaccttcacgctcgcgccctccgacggcggctgg
 P  L  F  P  T  C  A  N  S  T  F  T  L  A  P  S  D  G  G  W ctgatcggccccgccgccgaccccctacacctcctggctgcacaaagcgaccgactggatc
 L  I  G  P  A  A  D  P  Y  T  S  W  L  H  K  A  T  D  W  I ccagccttcatgcgctacatcgacgccacctggaagcctgcgggcggcatcgccgtttcc
 P  A  F  M  R  Y  I  D  A  T  W  K  P  A  G  G  I  A  V  S gagttcggttcaccgagcccttcgagcacgacaagaagctcctgggcgacatccgcgct
 E  F  G  F  T  E  P  F  E  H  D  K  K  L  L  G  D  I  R  A gatctggggcgggtgacgtattacaaggagtacctggcggcgctgttgctggcgatgagc
 D  L  G  R  V  T  Y  Y  K  E  Y  L  A  A  L  L  A  M  S gagggagtaaagattattggggtgctggcgtggacgattacggataatttggaatggacg
 E  G  V  K  I  I  G  V  L  A  W  T  I  T  D  N  L  E  W  T gccgggttcggagtcaagttcgggctgcagtacgtgaatttgacgacccaggagaggcac
 A  G  F  G  V  K  F  G  L  Q  Y  V  N  L  T  T  Q  E  R  H tataaggcgagtttctttgagttgaagaatatgattgagatgtataaggagaactag
 Y  K  A  S  F  F  E  L  K  N  M  I  E  M  Y  K  E  N  -

SEQ ID NO: 102
LENGTH: 538
TYPE: PRT
ORGANISM: M. phaseolina
MVTSMDLTVDDLWDIWIGSVAVASINTTVSPTPVPSAELIPPPPLHYPSWMTGHQTPLAQKNESWKFPRNFWW

GVASASYQVEGAVKDEGRAPSVWDALLHNVVDYSLYNETGDVANNHYYLYKQDIARLAAMGVPYYSFSLSWSR

ILPFGRGPVNEAGLAHYEDVIKTCLEYGVKPAVTLFHWDLPLYLYNLYGGWTNEQIVDDFVNYARIVFERYGN
```

-continued

KVPMWFTVNEPISFCTLQMPEHYFRRVPIPQKQQPYFCGQHVLLAHSKVYHLAKSMNLTGPITLKNNGYYKTP

LTNSTDDAIATQRAWDFNEGWFANPVFIDGEYPRYLKDYVATFLRNLTTEEKAAIHGSADFFAHDAYAAKFYM

APDAGIDACLANYSHPLFPTCANSTFTLAPSDGGWLIGPAADPYTSWLHKATDWIPAFMRYIDATWKPAGGIA

VSEFGFTEPFEHDKKLLGDIRADLGRVTYYKEYLAALLLAMSEGVKIIGVLAWTITDNLEWTAGFGVKFGLQY

VNLTTQERHYKASFFELKNMIEMYKEN*

SEQ ID NO: 103
LENGTH: 2229 (including 150 bp 5' UTR and 150 bp 3' UTR)
TYPE: DNA
ORGANISM: M. phaseolina
GCTGTGACGGCCATGTCGCCTTCGGTAGTCTCCGCTTCTAAGGCGTTTAGCCTGTTCAAGAACAGGAGGAGCA

GCTCTTGCACCATCCATTGCTTGTGCTTATAAAGTCCGCCTCTCTAGCTGTGGAAAGGTTCGTCACTATAACA

AACCATGTTTTCCCTTTTGGTGCTGAGTTGTGGTGCTGTGGCACTCGCCCAACAGGTCTATATCTCTGCCGAC

GGACCAATCCCCCGACCGCAGTGCTCAGCAAGCCAAACCTACTCGGCCACTTATGCCACTCCGACCTACGCGT

TCAGCAACTTCTCCTTCACACAAACCGAGACTGTCAGAACAGCTACGTCGATCAAGTCGGCGCCAATCACCAC

ATATGCCCCGCCATACGAGTCTCTCAGTCACCTGGTTCCAAACTTGAGCACAACCACATGGGGCAATTGGTAT

CCCAATGCGACCACGACAGCTGCCGATACGACCGACCCTTATGGACAAGCTGCATGGTCAGCGCTTTGGGAGC

ATGCCAGCCTTGCAAACTTCACCTTTAGGGGGCTGTACTCAACGACCGTATCTCCGACCCCGGTGCCTACTAG

TGAACTCGTTCTGCCACCCCCGGAATATTTTGTCCCGCAGGATTGCTACTCCTTCCCGGATACCTTCATGTTT

GGAGTTGCGGGATCCGCCTCTCAGATCGAGGGAGCCATTGCAGATGAAGGAAGAACGCCTTCTTTGATGGAAG

TTCTCATTCCTCCTTCGTCAGGCAAGCCAACCAACTACGTCACCAACGAGAACTACTACCTATACAAGCAAGA

CATCGAGCGTTTGGCTGCTATGGGCGTCAAGTACTACTCCTTGTCCATCCCGTGGACTCGCATCCTGCCGTTC

GTTGTTGAGGGATCTCCGGTCAACAAGCAAGGCCTCGATCATTACGATGACCTCATCAACTTTGTTCTTTCGC

GCGGGATGGTCCCAACCGTGACGCTGTTGCACTTCGATACGCCACTTCAGTTCTACGGGGACAACATTACATC

CGCTGCCGATCCCCCGCTTATCGGCTATACGAACGGAGCATATCAGAACGAGACCTTTGAGGATGCGTTCGTG

AACTATGGAAAAATTGTCATGACTCATTTCGCAGACCGTGTCCCGGTTTGGTTCACGTTCAACGAGCCATTGC

TCTACAGCTACAATGGCAAGAGTGTGGACACGGTCATCAAAGCACACGCAAGGCTCTACCACTTCTATCATGA

GGAGATCAATGGCACCGGCCAAGTCGGCATCAAGTTCAACGACAACTTCGGTGTCCCGCTTGATCCCACGAAT

TCGTCAGATGTCGAGGCGGCAAATCATTTCAATGACTTCCAGCTCGCCACTTTTGCCAACCCAATCTTCCTTG

GCAAGGACTATCCAGAAGCATTCAAAATCACCATTCCCGACTACGTTCCCCTCACTGACGAGGACCTGGAGTA

TATCGGAGGCACATCCGGTAAGTCTCGGCCAGCCGCTGCTGATCGGGCGCGGTCGAACAATGAACGAATGCTC

ACTGCTGTAGATTTCCTGGGGATTGATCCCTACACGGCAACGGTCGTCACGCCTGCTCCAAATGGTATTGCTG

TCTGCGCATCCAACACTTCGGATCCGCTTTTCCCCTACTGCGTCGAGCAATCTACTTTGACCAGCGCCGGTTG

GAACATTGGCTACCGCTCCCAAAGCTACGTCTACATCACGCCCAAATACCTGCGCACGTACCTGTCATACCTC

TGGAATACCTTCCGACACCCGGTCCTGATCACGGAGTTTGGGTTCCCGGTCTTCGGCGAGGCGGACAAGGAAG

ACCTCTCAGATCAACTGTATGACTTCCCGCGCAGTAATTATTACCTTTCCTTCATGAGCGAGGTGCTCAAGGC

TATATGGGAGGACAAAGTCCATGTCCTGGGTGCGTTTGCTTGGAGCTTTGCGGACAACTGGGAATTCGGTGAT

TACGACGCGCACTTTGGCATTCAGACGGTCAATCGCACCACGCAGGAGAGGCGGTACAAGAAGAGTTTCTTCG

ACTTGGTTGATTTTGTTGCCGCGAGGTCGAACTAGTGTGCGGTGAGTAGCCGCCATCTTGCCAAACCGGACAA

GACGTATAATTCATAATGGTATTGAGAGGAGCGCATGGGCTTCGATCGGAGCGAGATGGCTCCACACAGACAT

GCATTCAGAGACGCAGTGACAGATGGTCTGTGAGTGAAG

SEQ ID NO: 104
LENGTH: 1863
TYPE: DNA
ORGANISM: M. phaseolina
FEATURE NAME/KEY: CDS
LOCATION: (1)...(1863)

```
atgttttcccttttggtgctgagttgtggtgctgtggcactcgcccaacaggtctatatc
 M   F   S   L   L   V   L   S   C   G   A   V   A   L   A   Q   Q   V   Y   I tctgccgacggaccaatccccgaccgcagtgctcagcaagccaaacctactcggccact
 S   A   D   G   P   I   P   R   P   Q   C   S   A   S   Q   T   Y   S   A   T tatgccactccgacctacgcgttcagcaacttctccttcacacaaaccgagactgtcaga
 Y   A   T   P   T   Y   A   F   S   N   F   S   F   T   Q   T   E   T   V   R acagctacgtcgatcaagtcggcgccaatcaccacatatgccccgccatacgagtctctc
 T   A   T   S   I   K   S   A   P   I   T   T   Y   A   P   P   Y   E   S   L agtcacctggttccaaacttgagcacaaccacatggggcaattggtatcccaatgcgacc
 S   H   L   V   P   N   L   S   T   T   T   W   G   N   W   Y   P   N   A   T acgacagctgccgatacgaccgacccttatggacaagctgcatggtcagcgctttgggag
 T   T   A   A   D   T   T   D   P   Y   G   Q   A   A   W   S   A   L   W   E catgccagccttgcaaacttcacctttagggggctgtactcaacgaccgtatctccgacc
 H   A   S   L   A   N   F   T   F   R   G   L   Y   S   T   T   V   S   P   T ccggtgcctactagtgaactcgttctgccaccccggaatattttgtcccgcaggattgc
 P   V   P   T   S   E   L   V   L   P   P   P   E   Y   F   V   P   Q   D   C tactccttcccggataccttcatgtttggagttgcgggatccgcctctcagatcgaggga
 Y   S   F   P   D   T   F   M   F   G   V   A   G   S   A   S   Q   I   E   G gccattgcagatgaaggaagaacgccttctttgatggaagttctcattcctccttcgtca
 A   I   A   D   E   G   R   T   P   S   L   M   E   V   L   I   P   P   S   S ggcaagccaaccaactacgtcaccaacgagaactactacctatacaagcaagacatcgag
 G   K   P   T   N   Y   V   T   N   E   N   Y   Y   L   Y   K   Q   D   I   E cgtttggctgctatgggcgtcaagtactactccttgtccatcccgtggactcgcatcctg
 R   L   A   A   M   G   V   K   Y   Y   S   L   S   I   P   W   T   R   I   L ccgttcgttgttgagggatctccggtcaacaagcaaggcctcgatcattacgatgacctc
 P   F   V   V   E   G   S   P   V   N   K   Q   G   L   D   H   Y   D   D   L atcaactttgttctttcgcgcgggatggtcccaaccgtgacgctgttgcacttcgatacg
 I   N   F   V   L   S   R   G   M   V   P   T   V   T   L   L   H   F   D   T ccacttcagttctacggggacaacattacatccgctgccgatccccgcttatcggctat
 P   L   Q   F   Y   G   D   N   I   T   S   A   A   D   P   P   L   I   G   Y acgaacggagcatatcagaacgagacctttgaggatgcgttcgtgaactatggaaaaatt
 T   N   G   A   Y   Q   N   E   T   F   E   D   A   F   V   N   Y   G   K   I gtcatgactcatttcgcagaccgtgtcccggtttggttcacgttcaacgagccattgctc
 V   M   T   H   F   A   D   R   V   P   V   W   F   T   F   N   E   P   L   L tacagctacaatggcaagagtgtggacacggtcatcaaagcacacgcaaggctctaccac
 Y   S   Y   N   G   K   S   V   D   T   V   I   K   A   H   A   R   L   Y   H ttctatcatgaggagatcaatggcaccggccaagtcggcatcaagttcaacgacaacttc
 F   Y   H   E   E   I   N   G   T   G   Q   V   G   I   K   F   N   D   N   F ggtgtcccgcttgatccacgaattcgtcagatgtcgaggcggcaaatcatttcaatgac
 G   V   P   L   D   P   T   N   S   S   D   V   E   A   A   N   H   F   N   D ttccagctcgccacttttgccaacccaatcttccttggcaaggactatccagaagcattc
 F   Q   L   A   T   F   A   N   P   I   F   L   G   K   D   Y   P   E   A   F aaaatcaccattcccgactacgttcccctcactgacgaggacctggagtatatcggaggc
 K   I   T   I   P   D   Y   V   P   L   T   D   E   D   L   E   Y   I   G   G acatccgatttcctggggattgatccctacacggcaacggtcgtcacgcctgctccaaat
 T   S   D   F   L   G   I   D   P   Y   T   A   T   V   V   T   P   A   P   N ggtattgctgtctgcgcatccaacacttcggatccgcttttcccctactgcgtcgagcaa
 G   I   A   V   C   A   S   N   T   S   D   P   L   F   P   Y   C   V   E   Q tctactttgaccagcgccggttggaacattggctaccgctcccaaagctacgtctacatc
 S   T   L   T   S   A   G   W   N   I   G   Y   R   S   Q   S   Y   V   Y   I
```

```
acgcccaaatacctgcgcacgtacctgtcatacctctggaataccttccgacacccggtc
 T  P  K  Y  L  R  T  Y  L  S  Y  L  W  N  T  F  R  H  P  V ctgatcacggagtttgggttcccggtcttcggcgaggcggacaaggaagacctctcagat
 L  I  T  E  F  G  P  V  F  G  E  A  D  K  E  D  L  S  D caactgtatgacttcccgcgcagtaattattacctttccttcatgagcgaggtgctcaag
 Q  L  Y  D  F  P  R  S  N  Y  Y  L  S  F  M  S  E  V  L  K gctatatggaggacaaagtccatgtcctgggtgcgtttgcttggagctttgcggacaac
 A  I  W  E  D  K  V  H  V  L  G  A  F  A  W  S  F  A  D  N tgggaattcggtgattacgacgcgcactttggcattcagacggtcaatcgcaccacgcag
 W  E  F  G  D  Y  D  A  H  F  G  I  Q  T  V  N  R  T  T  Q gagaggcggtacaagaagagtttcttcgacttggttgattttgttgccgcgaggtcgaac
 E  R  R  Y  K  K  S  F  F  D  L  V  D  F  V  A  A  R  S  N tag
 -
```

SEQ ID NO: 105
LENGTH: 620
TYPE: PRT
ORGANISM: M. phaseolina
MFSLLVLSCGAVALAQQVYISADGPIPRPQCSASQTYSATYATPTYAFSNFSFTQTETVRTATSIKSAPITTY

APPYESLSHLVPNLSTTTWGNWYPNATTTAADTTDPYGQAAWSALWEHASLANFTFRGLYSTTVSPTPVPTSE

LVLPPPEYFVPQDCYSFPDTFMFGVAGSASQIEGAIADEGRTPSLMEVLIPPSSGKPTNYVTNENYYLYKQDI

ERLAAMGVKYYSLSIPWTRILPFVVEGSPVNKQGLDHYDDLINFVLSRGMVPTVTLLHFDTPLQFYGDNITSA

ADPPLIGYTNGAYQNETFEDAFVNYGKIVMTHFADRVPVWFTFNEPLLYSYNGKSVDTVIKAHARLYHFYHEE

INGTGQVGIKFNDNFGVPLDPTNSSDVEAANHFNDFQLATFANPIFLGKDYPEAFKITIPDYVPLTDEDLEYI

GGTSDFLGIDPYTATVVTPAPNGIAVCASNTSDPLFPYCVEQSTLTSAGWNIGYRSQSYVYITPKYLRTYLSY

LWNTFRHPVLITEFGFPVFGEADKEDLSDQLYDFPRSNYYLSFMSEVLKAIWEDKVHVLGAFAWSFADNWEFG

DYDAHFGIQTVNRTTQERRYKKSFFDLVDFVAARSN*

SEQ ID NO: 106
LENGTH: 2208 (including 150 bp 5' UTR and 150 bp 3' UTR)
TYPE: DNA
ORGANISM: M. phaseolina
TGCGACTTGAGGTTGCGACGGAGATGCGTGGGCCCTTTCATTTAACATGTCTTGGAACTTTTCACGCACTCTG

CCTGTTTTGTCACCGCGGACCGGGTTTTGCCTATGCATGTGCGCAGATCTTGTGTCCCACGTTTGACCCGTCT

GTCGATGTCTACGAACCTTTGTCTTTACCCATCTCTATGTCGTGGTACAGCGGTGCCCATACACTTCTCTGCC

ATCACAATGCAAAGCTCCGCCGCCGGATAGTGCCGCCAAAGCCTCATCAGCACGTCCGGATCTCTGGGACGGT

GGAAAGCAGGGTACTGTATACAATCACTGACTTGCGCCAGATTATTGGAATATCTTCGTCGGCCCCGTTTCCA

CCGCGTCTATCAACACCACGGTCGAGCCGACGCCGATCCCTTCCAGCTCCCTCATTCCACCGCCAGGGCTCTA

CTATCCGGCCTATCCTACCGGTCAACAGACCCCCCTACAGGCTAAAAATGAGAGCTGGTCATTTCCTTCTGAC

TTCTGGTGGGCGTCTCAAGCGCTTCTTACCAAGTAGAAGGCGCTGCAAAAGACGAAGGCAAAGGCCCAACAA

TATGGGACGTGTTTGCGCACAGAGTGAATGGCTACATCACGACCAACGAGACTGGCGACATCTCCGACAATGA

GTACTATCTTTACAAAGAGGGTGCGTCAAGTTTGAGACCTGAGACTAGCATTGAGACGTCCTTCTGCAGGCCC

CTTACTGACGCAGTTGGCAATCGGCAGATATCGCGCGCATCGCGGCCATGGGTGTGAAAGTGTACTCTTTCTC

CATCTCCTGGGCGCGCATCTTCCCCTTCGGTGCTGGCGCAGTGAATGAGCAAGGGCTCGCGCATTACGACGAC

TTGATCGATACATGCATTCAGTATGGCATCAAACCTGCTGTCACGCTCTACCACTGGGATCTGCCGCTCTTCC

TGCAGAACAAGTACGGCGGTTGGCTATCTTCCGACATCGTACCTGACTTCGTCGCTTACGCTCGTGTGCTGTT

TGAGCGCTGGGGTAATAAGGTGCCGTATTGGTACACATTCAACGAACCCATCGTTTTCTGCGGGTTCTATCCC

CTTCCATATCATTACtTGCCGCAACCTCCATACCAGACGTCCAGCAGCCCTACTACTGCGGTCACCACGTCC

TCCAAGCCCACGCGCAAGCTTACCGCCTCGCCAAATCCCTCAACCTCACCGGCACTGTCTCCCTGAAGCTCAA

-continued

```
CGGCGGCTACAAGATCCCCCTCACCAACAGCACCGCCGACGCCGAGGCGACCCAACGTGCCTGGGACTTCAAC

GAAGGCTGGTTCGCGAACCCGCTCTTCATCGACGGCGACTACCCATCCCGCCTCAAAGACTACGTTTCCGGAT

TCCTCCCCGCCTTCACTGATGCCGAAAAAACCGCCCTCAACGGCTCCGCCGACCTCTTCGCCCATGATGCCTA

CACAAGCAACTTCGTCGCCGTCCCGGATGACGGCATCACGTCCTGCATCGCCAATGCCTCCAATCCCCTCTAC

CCAGGCTGCTACAACACCACCTACACCTACTCGCGCGCCTCCGGCGGCTGGAACATCGGCCCCGCCGCCGACC

CCAAAGCGCCCTGGCTGCACAAGGCGACCGATTGGGTTCCCACGTTCCTGCGCTACATCCAGGACACCTGGCG

CCCGGCAGGCGGCATCGCTGTCAGCGAGTTCGGGTTCGGCGAGCCGTTCGAGCGGCAGAAGACGATCCTCGCC

GATATCCTGTTCGATCCAATCAGGAGCGCGTATTTCCATGACTATATGGAGGCCATTTTGATTGCGTTGGCGG

AAGGGACGCGGGTGGTGGGATGTCTGGCGTGGAGTTTGATTGATAATTTGGAGTGGACGACGGGGTATGATGT

CAAATTTGGGTTGCAGGTGAGTTTGAGGCACTTTCTTTGAGCGAGGCTGTAAGCTAATGGCAGGGGGATGCAG

TATGTCAACTTCACAACGCAGGAACGGTTTTATAAGGCGAGTTTCTTCGAGTATGTCAATGCGTTCAAGGTGT

ATCAGGAGCAGTGAATAGTTTTCAGTTGCCTTGTCCACTGCAACGTGATAGAGCTTCAATCAAATGTAATTAC

CGACTTTCCCATCACCTTGCCCGTTTTTAATATTCTCTTCCTACGCCGCGGAGCAGGAAGAGGAGAATATAGT

GTCCGCTTAACAAAGATT
```

SEQ ID NO: 107
LENGTH: 1629
TYPE: DNA
ORGANISM: M. phaseolina
FEATURE NAME/KEY: CDS
LOCATION: (1)...(1629)

```
atgtctacgaacctttgtctttacccatctctatgtcgtgattattggaatatcttcgtc
 M   S   T   N   L   C   L   Y   P   S   L   C   R   D   Y   W   N   I   F   V ggccccgtttccaccgcgtctatcaacaccacggtcgagccgacgccgatcccttccagc
 G   P   V   S   T   A   S   I   N   T   T   V   E   P   T   P   I   P   S   S tccctcattccaccgccagggctctactatccggcctatcctaccggtcaacagacccc
 S   L   I   P   P   P   G   L   Y   Y   P   A   Y   P   T   G   Q   Q   T   P ctacaggctaaaaatgagagctggtcatttccttctgacttctggtggggcgtctcaagc
 L   Q   A   K   N   E   S   W   S   F   P   S   D   F   W   W   G   V   S   S gcttcttaccaagtagaaggcgctgcaaaagacgaaggcaaaggcccaacaatatgggac
 A   S   Y   Q   V   E   G   A   A   K   D   E   G   K   G   P   T   I   W   D gtgtttgcgcacagagtgaatggctacatcacgaccaacgagactggcgacatctccgac
 V   F   A   H   R   V   N   G   Y   I   T   T   N   E   T   G   D   I   S   D aatgagtactatctttacaaagaggatatcgcgcgcatcgcggccatgggtgtgaaagtg
 N   E   Y   Y   L   Y   K   E   D   I   A   R   I   A   A   M   G   V   K   V tactcttttctccatctcctgggcgcgcatcttccccttcggtgctggcgcagtgaatgag
 Y   S   F   S   I   S   W   A   R   I   F   P   F   G   A   G   A   V   N   E caagggctcgcgcattacgacgacttgatcgatacatgcattcagtatggcatcaaacct
 Q   G   L   A   H   Y   D   D   L   I   D   T   C   I   Q   Y   G   I   K   P gctgtcacgctctaccactgggatctgccgctcttcctgcagaacaagtacggcggttgg
 A   V   T   L   Y   H   W   D   L   P   L   F   L   Q   N   K   Y   G   G   W ctatcttccgacatcgtacctgacttcgtcgcttacgctcgtgtgctgtttgagcgctgg
 L   S   S   D   I   V   P   D   F   V   A   Y   A   R   V   L   F   E   R   W ggtaataaggtgccgtattggtacacattcaacgaacccatcgtttctgcgggttctat
 G   N   K   V   P   Y   W   Y   T   F   N   E   P   I   V   F   C   G   F   Y cccctttccatatcattactttgccgcaacctccataccagacgtccagcagccctactac
 P   L   P   Y   H   Y   F   A   A   T   S   I   P   D   V   Q   Q   P   Y   Y tgcggtcaccacgtcctccaagcccacgcgcaagcttaccgcctcgccaaatccctcaac
 C   G   H   H   V   L   Q   A   H   A   Q   A   Y   R   L   A   K   S   L   N ctcaccggcactgtctccctgaagctcaacgcggctacaagatcccctcaccaacagc
 L   T   G   T   V   S   L   K   L   N   G   G   Y   K   I   P   L   T   N   S accgccgacgccgaggcgacccaacgtgcctgggacttcaacgaaggctggttcgcgaac
 T   A   D   A   E   A   T   Q   R   A   W   D   F   N   E   G   W   F   A   N
```

-continued

```
ccgctcttcatcgacggcgactacccatcccgcctcaaagactacgtttccggattcctc
 P  L  F  I  D  G  D  Y  P  S  R  L  K  D  Y  V  S  G  F  L cccgccttcactgatgccgaaaaaaccgccctcaacggctccgccgacctcttcgcccat
 P  A  F  T  D  A  E  K  T  A  L  N  G  S  A  D  L  F  A  H gatgcctacacaagcaacttcgtcgccgtcccggatgacggcatcacgtcctgcatcgcc
 D  A  Y  T  S  N  F  V  A  V  P  D  D  G  I  T  S  C  I  A aatgcctccaatcccctctacccaggctgctacaacaccacctacacctactcgcgcgcc
 N  A  S  N  P  L  Y  P  G  C  Y  N  T  T  Y  T  Y  S  R  A tccggcggctggaacatcggccccgccgccgaccccaaagcgccctggctgcacaaggcg
 S  G  G  W  N  I  G  P  A  A  D  P  K  A  P  W  L  H  K  A accgattgggttcccacgttcctgcgctacatccaggacacctggcgccggcaggcggc
 T  D  W  V  P  T  F  L  R  Y  I  Q  D  T  W  R  P  A  G  G atcgctgtcagcgagttcgggttcggcgagccgttcgagcggcagaagacgatcctcgcc
 I  A  V  S  E  F  G  F  G  E  P  F  E  R  Q  K  T  I  L  A gatatcctgttcgatccaatcaggagcgcgtatttccatgactatatggaggccatttg
 D  I  L  F  D  P  I  R  S  A  Y  F  H  D  Y  M  E  A  I  L attgcgttggcggaagggacgcgggtggtgggatgtctggcgtggagtttgattgataat
 I  A  L  A  E  G  T  R  V  V  G  C  L  A  W  S  L  I  D  N ttggagtggacgacggggtatgatgtcaaatttgggttgcagtatgtcaacttcacaacg
 L  E  W  T  T  G  Y  D  V  K  F  G  L  Q  Y  V  N  F  T  T caggaacggttttataaggcgagtttcttcgagtatgtcaatgcgttcaaggtgtatcag
 Q  E  R  F  Y  K  A  S  F  F  E  Y  V  N  A  F  K  V  Y  Q gagcagtga
 E  Q  -
```

SEQ ID NO: 108
LENGTH: 542
TYPE: PRT
ORGANISM: *M. phaseolina*
MSTNLCLYPSLCRDYWNIFVGPVSTASINTTVEPTPIPSSSLIPPPGLYYPAYPTGQQTPLQAKNESWSFPSD

FWWGVSSASYQVEGAAKDEGKGPTIWDVFAHRVNGYITTNETGDISDNEYYLYKEDIARIAAMGVKVYSFSIS

WARIFPFGAGAVNEQGLAHYDDLIDTCIQYGIKPAVTLYHWDLPLFLQNKYGGWLSSDIVPDFVAYARVLFER

WGNKVPYWYTFNEPIVFCGFYPLPYHYFAATSIPDVQQPYYCGHHVLQAHAQAYRLAKSLNLTGTVSLKLNGG

YKIPLTNSTADAEATQRAWDFNEGWFANPLFIDGDYPSRLKDYVSGFLPAFTDAEKTALNGSADLFAHDAYTS

NFVAVPDDGITSCIANASNPLYPGCYNTTYTYSRASGGWNIGPAADPKAPWLHKATDWVPTFLRYIQDTWRPA

GGIAVSEFGFGEPFERQKTILADILFDPIRSAYFHDYMEAILIALAEGTRVVGCLAWSLIDNLEWTTGYDVKF

GLQYVNFTTQERFYKASFFEYVNAFKVYQEQ*

SEQ ID NO: 109
LENGTH: 954 (including 150 bp 5' UTR and 150 bp 3' UTR)
TYPE: DNA
ORGANISM: *M. phaseolina*
AGATCGCCTTCCGCGCCCGACGTGTTGTCCGAGCTGTTGACAGCCAGTGGCATCCCCGCTGGAGCTCTAATTG

GTGGAGCTAGCACGAATGGCTACACTGCAGCCGAGAGCTACTATCTCTACAGGCAAGATATCGACCGTCTCGC

GGCCATGGGGATCAAGTTCTACTCCTTTAGCATCTCGTGGACACGGATTCTCCCTTTCGCCCTCCCCGGCTCT

CCTGTCAACTCAAATGGCCTTGAACATTACGACAACCTCACCAATTACGCTATCACCAAAGGGGTCCAGCCCG

TCGTGGCACTTCTGCATATGGACACGCCTCTGCAGTTCTTTGGAGACTACTACGTTGAAGGAATCAGGCAGAG

ACCCTACTACGGCTACTTCAACATGGGATACCAAAACGAGACCTTCGAAGAGGCTTTCGTAAATTACGGCAAA

ATCATTATGTCTCGCATCGCCGACAGAGTGCCGATCTGGGTGACGGTCAACAAGCCACAGACGGGCTGTGTGA

GCGGCCCTTCAATAGACCACATCATTAAAGCGCATGCCCGCCTCTATAATTTTTACCATGATGAGCTGCATGG

TACGGGTAAGATCACCATGAAGATGGCTTGGACGCCGGGAGTGCCGGAGGATCCTAAGAACGAGACGCATCTC

GTGGCCGTCCAGCACTACAACGACCTCCTGGCCGAAACCTTGAAACTGCTCGTGCTAGGCCAAGACTATCACG

ACGCCTTCAAGAACGCGATACAAGACTACGTCGCCCTGAGCGCAGGAGACCTCGCACCCCTCCGAACAGCATG

ATTTTGCTGACAAACGCAAACAGACATCCTCTCCTTCGACGGCTACAGTGCCGTATCAGTCTTCCCCGCCGTC

CCTGATCTCGATATCTGCGCCACCGACAACGCGACTTCCAGCCGCTACTATCCCACCTGTGCCGGCACAACCC

AGCGG

SEQ ID NO: 110
LENGTH: 654
TYPE: DNA
ORGANISM: *M. phaseolina*
FEATURE NAME/KEY: CDS
LOCATION: (1)...(654)

```
atggggatcaagttctactcctttagcatctcgtggacacggattctcccttcgccctc
 M   G   I   K   F   Y   S   F   S   I   S   W   T   R   I   L   P   F   A   L cccggctctcctgtcaactcaaatggccttgaacattacgacaacctcaccaattacgct
 P   G   S   P   V   N   S   N   G   L   E   H   Y   D   N   L   T   N   Y   A atcaccaaaggggtccagcccgtcgtggcacttctgcatatggacacgcctctgcagttc
 I   T   K   G   V   Q   P   V   V   A   L   L   H   M   D   T   P   L   Q   F tttggagactactacgttgaaggaatcaggcagagaccctactacggctacttcaacatg
 F   G   D   Y   Y   V   E   G   I   R   Q   R   P   Y   Y   G   Y   F   N   M ggataccaaaacgagaccttcgaagaggctttcgtaaattacggcaaaatcattatgtct
 G   Y   Q   N   E   T   F   E   E   A   F   V   N   Y   G   K   I   I   M   S cgcatcgccgacagagtgccgatctgggtgacggtcaacaagccacagacgggctgtgtg
 R   I   A   D   R   V   P   I   W   V   T   V   N   K   P   Q   T   G   C   V agcggcccttcaatagaccacatcattaaagcgcatgcccgcctctataattttttaccat
 S   G   P   S   I   D   H   I   I   K   A   H   A   R   L   Y   N   F   Y   H gatgagctgcatggtacgggtaagatcaccatgaagatggcttggacgccgggagtgccg
 D   E   L   H   G   T   G   K   I   T   M   K   M   A   W   T   P   G   V   P gaggatcctaagaacgagacgcatctcgtggccgtccagcactacaacgacctcctggcc
 E   D   P   K   N   E   T   H   L   V   A   V   Q   H   Y   N   D   L   L   A gaaaccttgaaactgctcgtgctaggccaagactatcacgacgccttcaagaacgcgata
 E   T   L   K   L   L   V   L   G   Q   D   Y   H   D   A   F   K   N   A   I caagactacgtcgccctgagcgcaggagacctcgcacccctccgaacagcatga
 Q   D   Y   V   A   L   S   A   G   D   L   A   P   L   R   T   A   -
```

SEQ ID NO: 111
LENGTH: 217
TYPE: PRT
ORGANISM: *M. phaseolina*

MGIKFYSFSISWTRILPFALPGSPVNSNGLEHYDNLTNYAITKGVQPVVALLHMDTPLQFFGDYYVEGIRQRP

YYGYFNMGYQNETFEEAFVNYGKIIMSRIADRVPIWVTVNKPQTGCVSGPSIDHIIKAHARLYNFYHDELHGT

GKITMKMAWTPGVPEDPKNETHLVAVQHYNDLLAETLKLLVLGQDYHDAFKNAIQDYVALSAGDLAPLRTA*

SEQ ID NO: 112
LENGTH: 3139 (including 150 bp 5' UTR and 150 bp 3' UTR)
TYPE: DNA
ORGANISM: *M. phaseolina*

TGCCGGCGCCGCTGTCGCCTTCTTATGCTGTGAGGCATTACGAGTCGGCTGTGCGGCTCGTGCGGATGTAGGA

CGGGTCGTGATAGATATAAAGTCCCTAGAATGGGCCGTCGCTTTGAGGCTCATCGAGCTTGTCAATCTCCCTT

CGCCATGGCTTCCGCAATCAACTTTCTGGCTCTGCTCGGGATTGTTACTTCCTTGGTGGCCCCGGCATCCGCC

TGGGACCATTCCCTGTACACCACCAGCCCGGCTGTTCTGCCTTCACGTAAGTGCCGTTTATTGCTCTCTGATT

TTTTCACCCAGTTTGTAGACTTGGGTTGGGTTGGCTGTGTTTTTATTCATTTTTCACACTACCACTGAATATG

AGCGCTGAGAGGATAATTTCTAACACCCACCAGCAAACACCACTGGCGCGGGATGGGAAGACGCGTTCGCCAA

GGCCAAGGACTTCTTGGCCGAGCTGACCTTGGAGGAGAAGGTTGCAATGGTCACTGGAACATCTGGTCCCTGC

CCTGTAAGTCTTATGCCTAGACCTTAAGACAACATCGAGTCTACATGTCCGCCAGAGTTCTACCATGGCAGTG

GCCACGACGTCGGCGTCAAAATTATTGCAACATGCCCGTTGCAGAGAGTTGAATTATGTACCTGGGCACATAT

GATCAATCTTTTGGCCACTTACATCCACATGTACTCTTCAACTCTCCTCGGAAATGGCAGGTTGCAATAATTC

AGCCCCCGACGTCATCACCGCCAAAACACCACGCAAAAAAAAAACCCCCCTTTTTCGCTTGAGCATTATGCTA

-continued

ATTTGGTCTAGGGTATGATCGCTCCCGTTGAGCGGCTCAACTTCACTGGGTTGTGCCTTCAAGACGGCCCGCT

GGCTATCAGACAGGCTGTGTATGCGAACGTCTTCCCTGCTGGTGTAAATATTGCTTCAACATGGGACCGCAAC

GCCTTCTACCAGCGCAGCAAGTACATGGGAGCTGAGTTCAAGGCTAAGGGTGCTCAAATTGCTCTTACTCCGG

TCGTGGGGCCTCTTGGTAGGGACCCATATGGTGGCCGTAACTGGGAGGGCTTCTCTCCTGACCCCTACCTGAG

CGGCGTGGGTGTCGAAGAATCTGTCTGGGGCATCCAGGGAGCCGGTGTGCAGGCAACGACGAAGCACTTCATT

GGCAATGAACAAGAAACGCAGCGCAACCCCAGCACCGCTGCTGACGGCACGACCATTATGTCCCTGTCGTCCA

ACATCGACGACAAGACGATGCATGAAAGCTACCTGTGGCCTTTCGCCAACGCAGTCCACGCTGGTACTGCTAG

CATTATGTGCTCCTACAACCGTATCAACGGCTCCTATGGTTGCCAGAACTCTAAGGCACTGAACGGCCTTCTC

AAGACTGAACTCAACTTCCAGGGCTACGTCATGTCCGACTGGGGTGCAGTTCACTCTGGCGTCGCGACCATCG

AGTCGGGACTCGATGTTAATATGCCGGGCGGTATTAGCTTCAGTTCGCCCAGTCCATCATACTGGGGAGAAAA

TGCAACTCTTGCGGTGACCAATGGCACCATCCCTGAGAGCAGGATCGATGACATGGTCCTCAGAGTTCTGACC

CCCTACTTCCATCTTGGCCAGGACAAAGACTTCCCTAAGGTTGACGCTTATTCTTCCATTCTCAACGGCAAGG

CGGAATCCACTTGGCTGTACGACTTCAAGGTCGGTACCGAGGCTGAAGTCGTGGATCTCCGCAACGAAGAGAC

AACCAAGTTCATCCGCGACTCTGCCGCGAACGGCACTATCCTTCTCAAGAACACAAATGGCGCTCTGCCTCTG

AAGGCTCCCAAGAACGTTGCTGTCTTTGGAAATGCTGCTACTGAGTACACCGACGGTCTCTACTCCCTCGTCG

GCGGTAGCCCCTTTAAGTCTCACGACGCTGAGCAGGGTACACTTGGTGCCGGTGGCGGTAGCGGTACGGGTCG

CTTCGCTCAAATTGTGACTCCTCTTGAAGCACTCAAGGCGAAGGCCAAGGAGGACGGCTCTCTACTTCAATAC

ATGCTCGAGAACGAAGCCATCATCCAGTATGGTACCGACGCCATATTCCCTCTCCCTGACGTCTGCCTTGTCT

TCATTAAGTCTTGGGCTACCGAGGGCTACGACCGCGAGACCATCTACCCCGAGTACAACGGTACGGGCGTCGT

CAACACTGTCGCCGCCAGCTGCAACAACACCGTCGTCGTCCACTACGGCACTGGCCCGACCCTCTTCCCCTTC

GCTACCAACCCCAATGTCACCGCCATCATCGCCGCGCACTTCCCCGGCCAGGAGTCTGGCAACACGCTCGTCG

ACATCCTCTACGGCGCCACCAACCCGTCCGGCCACCTCCCCTACACCATCCCCGTCTCGGACACCGTCTTCCC

CAAGACCCTCGTCAACAGCACCGCCCTGGTCGAAACAACCGACCCGGATGCGTGGCAGGCCGACTTCACCGAG

GGCAACATGATCGACTACCGCTACTACATCGCCACCAACAAGACCTCCTCCGTCCTCTACCCCTTCGGCTTCG

GCCTGTCCTACACCACCTTCGCCGCCTCCGACCTCGTCGTCGAGAAGGCCACCGACGCCTCTCTCGCCGGCAC

CACCCCGGCCGCCGACGCCAAGGTCGTGCCCGGCGGCAACAGCGAGCTGTGGGAGACCGTGTACACCGCCAAC

GTCACCGTCGCCAACACGGGCGACGTCGCCGGCGCCGCCGTCCCCCAGCTGTACCTCAACCTGCTGGACGCCG

GCGCGCCCGCCGGCACCCCTGCCTGGCAACTGCGCGGCTTCGACCGCGTGTGGCTCGCGCCAGGCGAGAGCAA

GACCGTCGGCTTCGAGCTGCTGAGGCGCGACGTCTCGTACTGGGACGTCGTGGCGCAGGACTGGAGGGTTCCC

GAGGGCGAGATCAAGGTCGAGGTCGGCTTCAACGTCGCGGAGAGGACGCTGAGTGCGACGTTGGCGTAAAGCA

GGATAGATGACGATTTAATGATAGGGTACGATAATAGCATTAGTTCTTATGACATCAGGTAATAGCAATCGAA

TGATAATCTCGAAATAACCTTCTGCCAGCACCTGGACTGTATTGTGTATGTGTATTGAGGCGACGTCTATTCT

SEQ ID NO: 113
LENGTH: 2406
TYPE: DNA
ORGANISM: *M. phaseolina*
FEATURE NAME/KEY: CDS
LOCATION: (1)...(2406)

```
atggcttccgcaatcaactttctggctctgctcgggattgttacttccttggtggccccg
 M  A  S  A  I  N  F  L  A  L  L  G  I  V  T  S  L  V  A  P gcatccgcctgggaccattccctgtacaccaccagcccggctgttctgccttcaccaaac
 A  S  A  W  D  H  S  L  Y  T  T  S  P  A  V  L  P  S  P  N accactggcgcgggatgggaagacgcgttcgccaaggccaaggacttcttggccgagctg
 T  T  G  A  G  W  E  D  A  F  A  K  A  K  D  F  L  A  E  L accttggaggagaaggttgcaatggtcactggaacatctggtccctgccctggtatgatc
 T  L  E  E  K  V  A  M  V  T  G  T  S  G  P  C  P  G  M  I
```

```
gctcccgttgagcggctcaacttcactgggttgtgccttcaagacggcccgctggctatc
 A  P  V  E  R  L  N  F  T  G  L  C  L  Q  D  G  P  L  A  I agacaggctgtgtatgcgaacgtcttccctgctggtgtaaatattgcttcaacatgggac
 R  Q  A  V  Y  A  N  V  F  P  A  G  V  N  I  A  S  T  W  D cgcaacgccttctaccagcgcagcaagtacatgggagctgagttcaaggctaagggtgct
 R  N  A  F  Y  Q  R  S  K  Y  M  G  A  E  F  K  A  K  G  A caaattgctcttactccggtcgtggggcctcttggtagggacccatatggtggccgtaac
 Q  I  A  L  T  P  V  V  G  P  L  G  R  D  P  Y  G  G  R  N tgggagggcttctctcctgaccctacctgagcggcgtgggtgtcgaagaatctgtctgg
 W  E  G  F  S  P  D  P  Y  L  S  G  V  G  V  E  E  S  V  W ggcatccagggagccggtgtgcaggcaacgacgaagcacttcattggcaatgaacaagaa
 G  I  Q  G  A  G  V  Q  A  T  T  K  H  F  I  G  N  E  Q  E acgcagcgcaacccagcaccgctgctgacggcacgaccattatgtccctgtcgtccaac
 T  Q  R  N  P  S  T  A  A  D  G  T  T  I  M  S  L  S  S  N atcgacgacaagacgatgcatgaaagctacctgtggccttcgccaacgcagtccacgct
 I  D  D  K  T  M  H  E  S  Y  L  W  P  F  A  N  A  V  H  A ggtactgctagcattatgtgctcctacaaccgtatcaacggctcctatggttgccagaac
 G  T  A  S  I  M  C  S  Y  N  R  I  N  G  S  Y  G  C  Q  N tctaaggcactgaacggccttctcaagactgaactcaacttccagggctacgtcatgtcc
 S  K  A  L  N  G  L  L  K  T  E  L  N  F  Q  G  Y  V  M  S gactggggtgcagttcactctggcgtcgcgaccatcgagtcgggactcgatgttaatatg
 D  W  G  A  V  H  S  G  V  A  T  I  E  S  G  L  D  V  N  M ccgggcggtattagcttcagttcgcccagtccatcatactggggagaaaatgcaactctt
 P  G  G  I  S  F  S  S  P  S  P  S  Y  W  G  E  N  A  T  L gcggtgaccaatggcaccatccctgagagcaggatcgatgacatggtcctcagagttctg
 A  V  T  N  G  T  I  P  E  S  R  I  D  D  M  V  L  R  V  L acccctacttccatcttggccaggacaaagacttccctaaggttgacgcttattcttcc
 T  P  Y  F  H  L  G  Q  D  K  D  F  P  K  V  D  A  Y  S  S attctcaacggcaaggcggaatccacttggctgtacgacttcaaggtcggtaccgaggct
 I  L  N  G  K  A  E  S  T  W  L  Y  D  F  K  V  G  T  E  A gaagtcgtggatctccgcaacgaagagacaaccaagttcatccgcgactctgccgcgaac
 E  V  V  D  L  R  N  E  E  T  T  K  F  I  R  D  S  A  A  N ggcactatccttctcaagaacacaaatggcgctctgcctctgaaggctcccaagaacgtt
 G  T  I  L  L  K  N  T  N  G  A  L  P  L  K  A  P  K  N  V gctgtctttggaaatgctgctactgagtacaccgacggtctctactccctcgtcggcgt
 A  V  F  G  N  A  A  T  E  Y  T  D  G  L  Y  S  L  V  G  G agccccttaagtctcacgacgctgagcagggtacacttggtgccggtggcggtagcggt
 S  P  F  K  S  H  D  A  E  Q  G  T  L  G  A  G  G  G  S  G acgggtcgcttcgctcaaattgtgactcctcttgaagcactcaaggcgaaggccaaggag
 T  G  R  F  A  Q  I  V  T  P  L  E  A  L  K  A  K  A  K  E gacggctctctacttcaatacatgctcgagaacgaagccatcatccagtatggtaccgac
 D  G  S  L  L  Q  Y  M  L  E  N  E  A  I  I  Q  Y  G  T  D gccatattccctctccctgacgtctgccttgtcttcattaagtcttgggctaccgagggc
 A  I  F  P  L  P  D  V  C  L  V  F  I  K  S  W  A  T  E  G tacgaccgcgagaccatctaccccgagtacaacggtacgggcgtcgtcaacactgtcgcc
 Y  D  R  E  T  I  Y  P  E  Y  N  G  T  G  V  V  N  T  V  A gccagctgcaacaacaccgtcgtcgtccactacggcactggcccgaccctcttccccttc
 A  S  C  N  N  T  V  V  V  H  Y  G  T  G  P  T  L  F  P  F gctaccaaccccaatgtcaccgccatcatcgccgcgcacttccccggccaggagtctggc
 A  T  N  P  N  V  T  A  I  I  A  A  H  F  P  G  Q  E  S  G aacacgctcgtcgacatcctctacggcgccaccaacccgtccggccacctcccctacacc
 N  T  L  V  D  I  L  Y  G  A  T  N  P  S  G  H  L  P  Y  T atccccgtctcggacaccgtcttccccaagaccctcgtcaacagcaccgccctggtcgaa
 I  P  V  S  D  T  V  F  P  K  T  L  V  N  S  T  A  L  V  E
```

-continued

```
acaaccgacccggatgcgtggcaggccgacttcaccgagggcaacatgatcgactaccgc
 T  T  D  P  D  A  W  Q  A  D  F  T  E  G  N  M  I  D  Y  R tactacatcgccaccaacaagacctcctccgtcctctaccccttcggcttcggcctgtcc
 Y  Y  I  A  T  N  K  T  S  S  V  L  Y  P  F  G  F  G  L  S tacaccaccttcgccgcctccgacctcgtcgtcgagaaggccaccgacgcctctctcgcc
 Y  T  T  F  A  A  S  D  L  V  V  E  K  A  T  D  A  S  L  A ggcaccaccccggccgccgacgccaaggtcgtgcccggcggcaacagcgagctgtgggag
 G  T  T  P  A  A  D  A  K  V  V  P  G  G  N  S  E  L  W  E accgtgtacaccgccaacgtcaccgtcgccaacacgggcgacgtcgccggcgccgccgtc
 T  V  Y  T  A  N  V  T  V  A  N  T  G  D  V  A  G  A  A  V ccccagctgtacctcaacctgctggacgccggcgcgcccgccggcacccctgcctggcaa
 P  Q  L  Y  L  N  L  L  D  A  G  A  P  A  G  T  P  A  W  Q ctgcgcggcttcgaccgcgtgtggctcgcgccaggcgagagcaagaccgtcggcttcgag
 L  R  G  F  D  R  V  W  L  A  P  G  E  S  K  T  V  G  F  E ctgctgaggcgcgacgtctcgtactgggacgtcgtggcgcaggactggagggttcccgag
 L  L  R  R  D  V  S  Y  W  D  V  V  A  Q  D  W  R  V  P  E ggcgagatcaaggtcgaggtcggcttcaacgtcgcggagaggacgctgagtgcgacgttg
 G  E  I  K  V  E  V  G  F  N  V  A  E  R  T  L  S  A  T  L gcgtaa
 A  -
```

SEQ ID NO: 114
LENGTH: 801
TYPE: PRT
ORGANISM: M. phaseolina
MASAINFLALLGIVTSLVAPASAWDHSLYTTSPAVLPSPNTTGAGWEDAFAKAKDFLAELTLEEKVAMVTGTS

GPCPGMIAPVERLNFTGLCLQDGPLAIRQAVYANVFPAGVNIASTWDRNAFYQRSKYMGAEFKAKGAQIALTP

VVGPLGRDPYGGRNWEGFSPDPYLSGVGVEESVWGIQGAGVQATTKHFIGNEQETQRNPSTAADGTTIMSLSS

NIDDKTMHESYLWPFANAVHAGTASIMCSYNRINGSYGCQNSKALNGLLKTELNFQGYVMSDWGAVHSGVATI

ESGLDVNMPGGISFSSPSPSYWGENATLAVTNGTIPESRIDDMVLRVLTPYFHLGQDKDFPKVDAYSSILNGK

AESTWLYDFKVGTEAEVVDLRNEETTKFIRDSAANGTILLKNTNGALPLKAPKNVAVFGNAATEYTDGLYSLV

GGSPFKSHDAEQGTLGAGGGSGTGRFAQIVTPLEALKAKAKEDGSLLQYMLENEAIIQYGTDAIFPLPDVCLV

FIKSWATEGYDRETIYPEYNGTGVVNTVAASCNNTVVVHYGTGPTLFPFATNPNVTAIIAAHFPGQESGNTLV

DILYGATNPSGHLPYTIPVSDTVFPKTLVNSTALVETTDPDAWQADFTEGNMIDYRYYIATNKTSSVLYPFGF

GLSYTTFAASDLVVEKATDASLAGTTPAADAKVVPGGNSELWETVYTANVTVANTGDVAGAAVPQLYLNLLDA

GAPAGTPAWQLRGFDRVWLAPGESKTVGFELLRRDVSYWDVVAQDWRVPEGEIKVEVGFNVAERTLSATLA*

SEQ ID NO: 115
LENGTH: 2981 (including 150 bp 5' UTR and 150 bp 3' UTR)
TYPE: DNA
ORGANISM: M. phaseolina
CTGCCCATCTGGCAACCGGGAAACAAACTTCGACTCGGGTTGGAGCCGCAGTGATTCTCGCATAAAGAGTCTC

CGTCCCGCCGCTATCATGGCGCTTCACTCTACGTTGATTCCGCTCATTTGCGCTTCCCCTTCCTTTAAGAAGC

CAAAATGAGAGGCCCGATCGCCTTCGCCGTGGCCGCGGCCGCGGTCAGCAATGCTCAAAGTAAGTAGCCCCAG

CCCCAAGGCAAAGAAAGTTGAACGGATCAACAAAAGGGGATACGATCAAAGAGCAGGGAATTCTCATCTGCCA

CGATACTGACTTCCCGCAACCCCAGCTTCCCACACGCCCACCGTCGACTGGACCGCGGCCTACGACAAAGCCA

CTTCGGCCCTCGCCCAGATCAACCAAACTGAAAAAGTTGGAATTGTCACTGGTGTCGGCTGGGGTAATGGTCC

CTGCGTCGGCAACACTTACCCAGTCCCCAAAATCGGCTATCCGTCACTGTGCCTTCAGGATGGTCCCTTgGGC

GTGCGGTATGCGTCCAACGTGAGCGCCTTTCCGGCGGGTATTCAAGCGCTGCAACTTGGGATCGGGAGTTGA

TCTACCAGCGCGGTCTCGCGCTGGGTAAGGAGGCCAAGGGGTTGGGTGTGAATGTGCAGTTGGGCCCGGTTTC

GGGAGCTCTTGGAAAGGTGGGGTTTTGAATTATATTCCTTGCACTAACTGCTTTCTACAATATCCCCTTGTGA

GCCAGACGCAGCAGACTTCCTCAGAGCTTTTTTGCTTCCTATTTCTTAAAGAGATACTGACAGCCACACGCAG

-continued

ATCCCTGAGGCCGGAAGGAACTGGGAGGGATTCTCCCCGGATCCGTACCTGGCCGGAATCTGCATGTTCGAGA
CGATTGTCGGCATGCAAGAGGGCGGTGTTCAGGCTTGCGCTAAGCATTATCTCCTCAATGAACAGGAGTTGAA
TCGAACTACGATTTCCGCCAACGCCGACGATCGGACGACGCACGAGTTGTACCTCTGGCCATTCGCCGATGCG
GTCAAGGCTGGAGTCACGTCTTTCATGTGCTCCTACGTAAGTGCAGCATACTTCGCCAGTCCGGAAAAACTGG
CGGACTAAAAAGAGTAATAGAACAAACTCAACGGCACGTGGGCTTGCGAGAACGACAAGATCCTGAACGGCCT
CTTGAAGGACGAGCTCGACTACAAGGGCTTTGTCATGACCGACTGGGGCGCGCACCACACCACCGTCGACAGC
GCCATCGCAGGCCTCGACATGTCGATGCCGGGAACTGACTACGGCAAGTCGCCCGAAAGCCTCTACTGGGGCG
CCAACCTCACCGCAGCTGTTGAGGCCGGCGACATCCCGCAGGAGCGCCTCGACGACATGGTCCTCCGCATCCT
CGCCGCCTGGTACGCCCTTGGCCAGGACGATCCGGCCTTCCCTGCAGTGCAGTTCGACTCGTGGGTCGACGGT
GAGAAGGGCGGCTACGAGGCGCCGCAGACGCAGCACAACGAGCTCGCCCGCGCCGTCGCCCGCGACGGTATCG
TCCTGCTTAAGAATGAGAATGCCACTCTCCCCATCAAGCCGACCTCCGGCAGCCTCGCAATCATCGGTGACGA
CGCGCGCGTCAATCCCGCCGGCCCCAACGCCTGCTCTGACCGCGCCTGCACCAACGGCACGCTCGCCGTCGGC
TGGGGATCTGGCGCGAATGAGTTTCCCGTAAGCACACATGCAAATACCACGTCATCCGTCTACAAGAAACAGC
CTTTTTATTAACGAACATGAACCGCACATAGTACCTCATCGCGCCGCTCGACGCCATCCGAGAGCGCGCCTCC
GCCGCCGGCACCACCATCATCGCCTCTCCCACCGACGACCAGGCGGCGGGCGCCAGCGCTGCCGCCGCCGCAG
AGACGGCCATCGTCTTCATCGTGTCCAACAGTGGTGAGGAGTATCTGACCGTCGAGAACAACGTCGGAGACCG
CATCAACCTCGACCCTTGGCACGATGGCAATGGGCTAGTAGCCGCGGTTGCCGAGGCCGCTGCGGGCAAGCCC
GTCGTCGTCGTCGCGCATAGCGTCGGCCCGATCATTTTGGAGTCTATCCTCAGCCACGAGAATGTCGTCGCGC
TGGTGTGGGCGGGATTGGGCGGGCAGGAGCAGGGCAACGCGTTGGCGGATGTGCTGTTCGGAGACGTTAGTCC
GAGCGGCAAGCTGCCCTACACGATTGCGAAGGCGGCGGAGGACTACGGGACGAAGCTGGTGGGGCCGGATGTG

GATGATGAGTTTGAGGAGGGGCTGTACATCGACTACAGGCATTTCGACAAGGCGGGGATCGAGCCGCGGTACG

AGTTCGGGTTTGGCCTGTGTAAGTGCTCCTTTCCTTGCCTTCACCGCATTTGTTTTGTGTGCGGACTGAGGCG
CAGGATTGAACTGACTTTTTGGTTTGATGCGCGCAGCCTACACCAACTTCACCTACTCGGACATCGCAATTAC
CAAGACGGCAGCCAGCAATGCCACCGCTGGATCTACGGACCTCTACGCCCCGTTCGCCACCGTCACGGCCACC
ATCGCCAACTCCGGCGACGTCGCCGGTGCGGAGGTCGCTCAGCTGTACCTCTCGCTGCCCGCTGGCATTGACG
CCCCGCCGAAGCAGCTGCGCGGCTTCGAGAAGATCAGTCTCGAGGCCGGTGCCAGCGCATCTGTCGAGTTCGT
GCTTAGGCGCAAGGATGCCAGCTACTGGAATGTCGAGCGGCAGCAATGGATCTTGCCGACGGGCGATTTTGGC
ATCGCGGTAGCGGCGAGCTCAAGGGATTTGAGACTGGAGGGGACGCTGACGGTTTAGAGGTGAGAAGGAGGCG
TAGAGTCTTGTAGATGATTGAGAGTGTCTTTATTGACACAGGCAGCGGAGCAGTCTCCCGGACGGATATGTTC
GAGGTAACTTATCCCAATGGAATCTGCGGCATTGTTGTCCTCTACTTTCACGCCGTGGCAG

SEQ ID NO: 116
LENGTH: 2214
TYPE: DNA
ORGANISM: *M. phaseolina*
FEATURE NAME/KEY: CDS
LOCATION: (1)...(2214)

```
atgagaggcccgatcgccttcgccgtggccgcggccgcggtcagcaatgctcaaacttcc
 M  R  G  P  I  A  F  A  V  A  A  A  A  V  S  N  A  Q  T  S cacacgcccaccgtcgactggaccgcggcctacgacaaagccacttcggccctcgcccag
 H  T  P  T  V  D  W  T  A  A  Y  D  K  A  T  S  A  L  A  Q atcaaccaaactgaaaaagttggaattgtcactggtgtcggctggggtaatggtccctgc
 I  N  Q  T  E  K  V  G  I  V  T  G  V  G  W  G  N  G  P  C gtcggcaacacttacccagtccccaaaatcggctatccgtcactgtgccttcaggatggt
 V  G  N  T  Y  P  V  P  K  I  G  Y  P  S  L  C  L  Q  D  G cccttgggcgtgcggtatgcgtccaacgtgagcgcctttccggcgggtattcaagccgct
 P  L  G  V  R  Y  A  S  N  V  S  A  F  P  A  G  I  Q  A  A
```

-continued

```
gcaacttgggatcgggagttgatctaccagcgcggtctcgcgctgggtaaggaggccaag
 A  T  W  D  R  E  L  I  Y  Q  R  G  L  A  L  G  K  E  A  K gggttgggtgtgaatgtgcagttgggcccggtttcgggagctcttggaaagatccctgag
 G  L  G  V  N  V  Q  L  G  P  V  S  G  A  L  G  K  I  P  E gccggaaggaactggagggattctccccggatccgtacctggccggaatctgcatgttc
 A  G  R  N  W  E  G  F  S  P  D  P  Y  L  A  G  I  C  M  F gagacgattgtcggcatgcaagagggcggtgttcaggcttgcgctaagcattatctcctc
 E  T  I  V  G  M  Q  E  G  G  V  Q  A  C  A  K  H  Y  L  L aatgaacaggagttgaatcgaactacgatttccgccaacgccgacgatcggacgacgcac
 N  E  Q  E  L  N  R  T  T  I  S  A  N  A  D  D  R  T  T  H gagttgtacctctggccattcgccgatgcggtcaaggctggagtcacgtctttcatgtgc
 E  L  Y  L  W  P  F  A  D  A  V  K  A  G  V  T  S  F  M  C tcctacaacaaactcaacggcacgtgggcttgcgagaacgacaagatcctgaacggcctc
 S  Y  N  K  L  N  G  T  W  A  C  E  N  D  K  I  L  N  G  L ttgaaggacgagctcgactacaagggctttgtcatgaccgactggggcgcgcaccacacc
 L  K  D  E  L  D  Y  K  G  F  V  M  T  D  W  G  A  H  H  T accgtcgacagcgccatcgcaggcctcgacatgtcgatgccgggaactgactacggcaag
 T  V  D  S  A  I  A  G  L  D  M  S  M  P  G  T  D  Y  G  K tcgcccgaaagcctctactggggcgccaacctcaccgcagctgttgaggccggcgacatc
 S  P  E  S  L  Y  W  G  A  N  L  T  A  A  V  E  A  G  D  I ccgcaggagcgcctcgacgacatggtcctccgcatcctcgccgctggtacgcccttggc
 P  Q  E  R  L  D  D  M  V  L  R  I  L  A  A  W  Y  A  L  G caggacgatccggccttccctgcagtgcagttcgactcgtgggtcgacggtgagaagggc
 Q  D  D  P  A  F  P  A  V  Q  F  D  S  W  V  D  G  E  K  G ggctacgaggcgccgcagacgcagcacaacgagctcgcccgcgccgtcgcccgcgacggt
 G  Y  E  A  P  Q  T  Q  H  N  E  L  A  R  A  V  A  R  D  G atcgtcctgcttaagaatgagaatgccactctcccccatcaagccgacctccggcagcctc
 I  V  L  L  K  N  E  N  A  T  L  P  I  K  P  T  S  G  S  L gcaatcatcggtgacgacgcgcgcgtcaatcccgccggccccaacgcctgctctgaccgc
 A  I  I  G  D  D  A  R  V  N  P  A  G  P  N  A  C  S  D  R gcctgcaccaacggcacgctcgccgtcggctggggatctggcgcgaatgagtttccctac
 A  C  T  N  G  T  L  A  V  G  W  G  S  G  A  N  E  F  P  Y ctcatcgcgccgctcgacgccatccgagagcgcgcctccgccgccggcaccaccatcatc
 L  I  A  P  L  D  A  I  R  E  R  A  S  A  A  G  T  T  I  I gcctctcccaccgacgaccaggcggcgggcgccagcgctgccgccgccgcagagacggcc
 A  S  P  T  D  D  Q  A  A  G  A  S  A  A  A  A  E  T  A atcgtcttcatcgtgtccaacagtggtgaggagtatctgaccgtcgagaacaacgtcgga
 I  V  F  I  V  S  N  S  G  E  E  Y  L  T  V  E  N  N  V  G gaccgcatcaacctcgacccttggcacgatggcaatgggctagtagccgcggttgccgag
 D  R  I  N  L  D  P  W  H  D  G  N  G  L  V  A  A  V  A  E gccgctgcgggcaagcccgtcgtcgtcgtcgcgcatagcgtcggcccgatcatttggag
 A  A  A  G  K  P  V  V  V  V  A  H  S  V  G  P  I  I  L  E tctatcctcagccacgagaatgtcgtcgcgctggtgtgggcgggattgggcgggcaggag
 S  I  L  S  H  E  N  V  V  A  L  V  W  A  G  L  G  G  Q  E cagggcaacgcgttggcggatgtgctgttcggagacgttagtccgagcggcaagctgccc
 Q  G  N  A  L  A  D  V  L  F  G  D  V  S  P  S  G  K  L  P tacacgattgcgaaggcggcggaggactacgggacgaagctggtggggccggatgtggat
 Y  T  I  A  K  A  A  E  D  Y  G  T  K  L  V  G  P  D  V  D gatgagtttgaggaggggctgtacatcgactacaggcatttcgacaaggcggggatcgag
 D  E  F  E  E  G  L  Y  I  D  Y  R  H  F  D  K  A  G  I  E ccgcggtacgagttcgggtttggcctgtcctacaccaacttcacctactcggacatcgca
 P  R  Y  E  F  G  F  G  L  S  Y  T  N  F  T  Y  S  D  I  A attaccaagacggcagccagcaatgccaccgctggatctacggacctctacgccccgttc
 I  T  K  T  A  A  S  N  A  T  A  G  S  T  D  L  Y  A  P  F
```

-continued

```
gccaccgtcacggccaccatcgccaactccggcgacgtcgccggtgcggaggtcgctcag
 A  T  V  T  A  T  I  A  N  S  G  D  V  A  G  A  E  V  A  Q ctgtacctctcgctgcccgctggcattgacgccccgccgaagcagctgcgcggcttcgag
 L  Y  L  S  L  P  A  G  I  D  A  P  P  K  Q  L  R  G  F  E aagatcagtctcgaggccggtgccagcgcatctgtcgagttcgtgcttaggcgcaaggat
 K  I  S  L  E  A  G  A  S  A  S  V  E  F  V  L  R  R  K  D gccagctactggaatgtcgagcggcagcaatggatcttgccgacgggcgatttggcatc
 A  S  Y  W  N  V  E  R  Q  Q  W  I  L  P  T  G  D  F  G  I gcggtagcggcgagctcaagggatttgagactggaggggacgctgacggtttag
 A  V  A  A  S  S  R  D  L  R  L  E  G  T  L  T  V  -
```

SEQ ID NO: 117
LENGTH: 737
TYPE: PRT
ORGANISM: M. phaseolina
MRGPIAFAVAAAAVSNAQTSHTPTVDWTAAYDKATSALAQINQTEKVGIVTGVGWGNGPCVGNTYPVPKIGYP

SLCLQDGPLGVRYASNVSAFPAGIQAAATWDRELIYQRGLALGKEAKGLGVNVQLGPVSGALGKIPEAGRNWE

GFSPDPYLAGICMFETIVGMQEGGVQACAKHYLLNEQELNRTTISANADDRTTHELYLWPFADAVKAGVTSFM

CSYNKLNGTWACENDKILNGLLKDELDYKGFVMTDWGAHHTTVDSAIAGLDMSMPGTDYGKSPESLYWGANLT

AAVEAGDIPQERLDDMVLRILAAWYALGQDDPAFPAVQFDSWVDGEKGGYEAPQTQHNELARAVARDGIVLLK

NENATLPIKPTSGSLAIIGDDARVNPAGPNACSDRACTNGTLAVGWGSGANEFPYLIAPLDAIRERASAAGTT

IIASPTDDQAAGASAAAAAETAIVFIVSNSGEEYLTVENNVGDRINLDPWHDGNGLVAAVAEAAAGKPVVVVA

HSVGPIILESILSHENVVALVWAGLGGQEQGNALADVLFGDVSPSGKLPYTIAKAAEDYGTKLVGPDVDDEFE

EGLYIDYRHFDKAGIEPRYEFGFGLSYTNFTYSDIAITKTAASNATAGSTDLYAPFATVTATIANSGDVAGAE

VAQLYLSLPAGIDAPPKQLRGFEKISLEAGASASVEFVLRRKDASYWNVERQQWILPTGDFGIAVAASSRDLR

LEGTLTV*

SEQ ID NO: 118
LENGTH: 3381 (including 150 bp 5' UTR and 150 bp 3' UTR)
TYPE: DNA
ORGANISM: M. phaseolina
CCGCGCCTCCCTAGACCGGAAAGCATGCAAGTCATGACCGGACCTTGCACTGTATATAAGAGAAATGTCAAG

ACCGTTTCGTTTCCTTTGCCATCGACAACGGCGTCCCTTGGCCCTCCTCCGAACTCCGACTGCTTGTTTTGAC

AGCCATGCTGCTTGACCGGCTGCCTCTGGTGGCCGCTTTTGGCTCCGTATGCTCGGCAGGGGCCATCTCGGTC

CGGCAGAGCTCGTCCGGTGTCGACAGCTGCCCGGGATACACGGCTTCGAATGTTGTTGACTCGGGTACTACGC

TTACTGCCGATCTAAGCCTGGCGGGCGCCTCATGCAATGCTTACGGCGACGATCTCACAGATCTGAAGCTCAA

CGTCGAGTACCAGACCGGTGAGTAGCAATACCTTTTTCCTTGCTTGTCGCATCGACTTGGAAACAGCGGGCGG

CCAGGGCAGCATCAGGCCTCAAAGCTTCTCCGATTGGTGACTGGACCGGCTGGGGCAAATATACCGCTACACG

TCACACGGAAGCGTGATGGCAAGCTCGCTTCTGCATTACAGCTGTTTCAAACCCATGCTTCACACCGGTCGTC

TGCAAGTTTTCGTTGCTGTCTCCCGAGTTCCTCTCTCTCTCCATTGCATTAGCCGGCATAAATTCTTGGCGCC

ATTCGAAACGGTTGCTGACGCGGGAGAAAACTGCACAGCCAATCGCCTCCATGTCCAAATCTATGACGCGGCA

GAAAATGTCTACCAGGTGCCGGAATCCGTCCTCCCACGTCCGAATGCTGGAAATGGCTCCGCTGCGGCGTCTG

CCATCCAGTTCAAGTGGGTTGAGAATCCATTTTCGTTTTCTGTCGTCCGCACGGCAACCAATGAGACGCTCTT

CGACACTGCTGACTCGCCGCTCGTGTTCGAGACGCAGTATTGGAGACTGAGGACCAAGTTACCCAGTGAACCG

AATCTCTACGGCTTGGGCGAGCACAGTGATTCGTTTCGTCTGAATACCACCAACTACACCCGTACGATCTGGA

ACAGAGATGCCTATGGTGTTCCTCCTGGATCAAATTTGTACGGCGCCCACCCTGTCTACTTTGACCACAGGGG

TCCTTCAGGCACTCACGGTGTCTTTTTGCTGAATTCCAACGGGATTGAAGCGAAAATCAACAACACCGATGGT

CAGTACCTGGAGTACAATGTCCTTGGCGGCATTGTCGACCTCTATTTCCTCGCGGGCCCGACTCCGAAGGATG

TCAGCAAGCAATATGCCGAAGTAGTGGGACTTCCCGCAATGCAAGCATACTGGGCCTTTGGCTTCCACCAGTG
```

```
CAGATATGGGTACCGCGACGTCTATGATGTCGCGGAAGTCGTCGCCAACTATTCGCTGGCCGGCATTCCTCTC

GAGACCATGTGGACAGACATTGACTACATGGACCTCAGGAAAGTCTTTACGCTGGACCCGGCGCGCTTTCCGC

TTGAGTTGGTGCGCGAGTTGGTGAATTATCTGCACGCACATCAACAGCACTACATCGTCATGGTTGACCCAGC

AGTCGCCTATCGGAACAACACGGCATACGATATCGGGGACCAGCAGGACGTATTCCTCAAAGTTTCGAACGGC

TCCTATTTCATTGGAGTGGTCTGGCCTGGTCCGACGGTATTTCCTGACTGGTTCCACCCCAACACCCAGCCTT

ACTGGGACGATCAATTCGCAAGCTTCTTCAGCGCCGACACAGGAGTAGACATCGACGCGTTGTGGATCGACAT

GAACGAAGCGGCCAACTTTTGCGTCTTTCCCTGTTCTGATCCTTTCGGCTACGCGGAAGCAAACAATCAGCCG

CCCGGACCCGCCGCCAGTGCGCGCCAATAGCGGACGACCCATTCCCGGCTTCCCTGCCAACTTTCAACCCGGCG

GAGTTACTCCACCTAGCAGGGTCAGGACCAGACGGCAGACGGCTGGTACCAAGGCCGGCCTGCCGGGACGAGA

CCTTCTAAACCCAGAATATACCATTGCGAACTTGGCTGGCGTGATTTCCGCAAACACCATCAACACGGATGTG

ATCCACCATAATGGCTTGGCCGAGTACGACACGCACAACCTGTACGGCACCATGATGTCGACGGCGAGCAGAA

TCGCCATGGAGAAGCGCCGACCTGGCAGGAGACCGCTGGTAATCACCCGCAGCACCTTTGCAGGCGCTGGGAG

GGACGTAGGGCACTGGCTAGGGGATAATCTTTCGGATTGGGAGCATTACAGGTGAGAATGAAGCCAAGCGCGA

GCGCGAAATGATGTGGCTGACGAACGAACAGATTCTCGATTTCCCAACTTCTTCAGTTTGCCGCTCTGTACCA

GGTGCCTATGGTTGGCTCTGATGTCTGTGGGTTCGGGTCCAACACAACGGAGACTTTGTGCGCGAGATGGGCG

CTGCTGGGAGCATTTTCTACGTTCTACAGGGTAAGTCGGGATGAAGCACTGAGGCCTGACATTGGCTGACAGT

CCTTTCAGAATCACAATCAGGACAACGCAATTTCGCAGGAATTCTACAGGTGGCCGCTGGTGACGGAGGCGGC

CAAGAATGCAATCAGCATACGGTACCAGCTGCTTGACTACATCTACACCGCCTTCCAACGGCAGACTCAAACG

GGTGAGCCAGTGGTCAACCCGCTATTCTTCAACTATCCAACCGACGCAAACACGTTCGGCATCGATTTGCAGT

ACTTTTACGGAGACTCGATTCTCGTGAGCCCGGTGACGGAAGAGAACGTAACTACGGTCGACATCTACCTGCC

AGATGACATCTTTTACGACTTCCACACCGGCGAGACGGTGCGAGGGAACGGCTCGTTCATCACGCTCCCTGAC

GTCCCATACACGACCATTCCCCTGCACGTGAGGGGAGGCAGCATCATCCCGCTGCGAGCGGCATCAGCCAACA

CGACGACGGAGCTGCGAAAGCAGAATTTCACGCTGCTCATTGCTCCCGGTTTGGACGGCACAGCCAGTGGCAG

CCTGTACCTGGATGAGGGCGATGCGATCGCGCAGCCGGCCACGTCGGAGATTCAATTCAACTACGACGGGCAG

AAGCTGGTGCTGAGCGGATCGTTTGGATACAATTCGGGGGTGGTGATAAGCGGGGTGCGGGTGCTGGGATCGT

CTGGCAACGGCACAACATCAGCGGGCAGGATCATGGCAGCTAAGGCGCCACTGTCGATTGCGCTCGACTCGGC

GGCAGAGATAGCATTGTAGAGCGGTAGCCGAAAGCAGGGAAGAGCGAGCCACTATGACCACTTGGCTCGCATC

GGCTGATGACTGGACTGTAGCTTTTTTCTATTAGTGCGCTGAGATGCCCGTGACTCGGTGCAGGATGGCGGCC

GTGACAGCCGACGTGGCTGATGC

SEQ ID NO: 119
LENGTH: 2664
TYPE: DNA
ORGANISM: M. phaseolina
FEATURE NAME/KEY: CDS
LOCATION: (1)...(2664)
atgctgcttgaccggctgcctctggtggccgcttttggctccgtatgctcggcaggggcc
 M   L   L   D   R   L   P   L   V   A   A   F   G   S   V   C   S   A   G   A atctcggtccggcagagctcgtccggtgtcgacagctgcccgggatacacggcttcgaat
 I   S   V   R   Q   S   S   S   G   V   D   S   C   P   G   Y   T   A   S   N gttgttgactcgggtactacgcttactgccgatctaagcctggcgggcgcctcatgcaat
 V   V   D   S   G   T   T   L   T   A   D   L   S   L   A   G   A   S   C   N gcttacggcgacgatctcacagatctgaagctcaacgtcgagtaccagaccgccaatcgc
 A   Y   G   D   D   L   T   D   L   K   L   N   V   E   Y   Q   T   A   N   R ctccatgtccaaatctatgacgcggcagaaaatgtctaccaggtgccggaatccgtcctc
 L   H   V   Q   I   Y   D   A   A   E   N   V   Y   Q   V   P   E   S   V   L ccacgtccgaatgctggaaatggctccgctgcggcgtctgccatccagttcaagtgggtt
 P   R   P   N   A   G   N   G   S   A   A   A   S   A   I   Q   F   K   W   V
```

-continued

```
gagaatccattttcgttttctgtcgtccgcacggcaaccaatgagacgctcttcgacact
 E   N   P   F   S   F   S   V   V   R   T   A   T   N   E   T   L   F   D   T gctgactcgccgctcgtgttcgagacgcagtattggagactgaggaccaagttaccagt
 A   D   S   P   L   V   F   E   T   Q   Y   W   R   L   R   T   K   L   P   S gaaccgaatctctacggcttgggcgagcacagtgattcgtttcgtctgaataccaccaac
 E   P   N   L   Y   G   L   G   E   H   S   D   S   F   R   L   N   T   T   N tacacccgtacgatctggaacagagatgcctatggtgttcctcctggatcaaatttgtac
 Y   T   R   T   I   W   N   R   D   A   Y   G   V   P   P   G   S   N   L   Y ggcgcccaccctgtctactttgaccacaggggtccttcaggcactcacggtgtcttttg
 G   A   H   P   V   Y   F   D   H   R   G   P   S   G   T   H   G   V   F   L ctgaattccaacgggattgaagcgaaaatcaacaacaccgatggtcagtacctggagtac
 L   N   S   N   G   I   E   A   K   I   N   N   T   D   G   Q   Y   L   E   Y aatgtccttggcggcattgtcgacctctatttcctcgcgggccccgactccgaaggatgtc
 N   V   L   G   G   I   V   D   L   Y   F   L   A   G   P   T   P   K   D   V agcaagcaatatgccgaagtagtgggacttcccgcaatgcaagcatactgggcctttggc
 S   K   Q   Y   A   E   V   V   G   L   P   A   M   Q   A   Y   W   A   F   G ttccaccagtgcagatatgggtaccgcgacgtctatgatgtcgcggaagtcgtcgccaac
 F   H   Q   C   R   Y   G   Y   R   D   V   Y   D   V   A   E   V   V   A   N tattcgctggccggcattcctctcgagaccatgtggacagacattgactacatggacctc
 Y   S   L   A   G   I   P   L   E   T   M   W   T   D   I   D   Y   M   D   L aggaaagtctttacgctggacccggcgcgctttccgcttgagttggtgcgcgagttggtg
 R   K   V   F   T   L   D   P   A   R   F   P   L   E   L   V   R   E   L   V aattatctgcacgcacatcaacagcactacatcgtcatggttgacccagcagtcgcctat
 N   Y   L   H   A   H   Q   Q   H   Y   I   V   M   V   D   P   A   V   A   Y cggaacaacacggcatacgatatcggggaccagcaggacgtattcctcaaagtttcgaac
 R   N   N   T   A   Y   D   I   G   D   Q   Q   D   V   F   L   K   V   S   N ggctcctatttcattggagtggtctggcctggtccgacggtatttcctgactggttccac
 G   S   Y   F   I   G   V   V   W   P   G   P   T   V   F   P   D   W   F   H cccaacacccagccttactgggacgatcaattcgcaagcttcttcagcgccgacacagga
 P   N   T   Q   P   Y   W   D   D   Q   F   A   S   F   F   S   A   D   T   G gtagacatcgacgcgttgtggatcgacatgaacgaagcggccaacttttgcgtctttccc
 V   D   I   D   A   L   W   I   D   M   N   E   A   A   N   F   C   V   F   P tgttctgatccttcggctacgcggaagcaaacaatcagccgccggacccgccgccagtg
 C   S   D   P   F   G   Y   A   E   A   N   N   Q   P   P   D   P   P   P   V cgcgccaatagcggacgacccattcccggcttccctgccaacttttcaacccggcggagtt
 R   A   N   S   G   R   P   I   P   G   F   P   A   N   F   Q   P   G   G   V actccacctagcagggtcaggaccagacggcagacggctggtaccaaggccggcctgccg
 T   P   P   S   R   V   R   T   R   R   Q   T   A   G   T   K   A   G   L   P ggacgagaccttctaaacccagaatataccattgcgaacttggctggcgtgatttccgca
 G   R   D   L   L   N   P   E   Y   T   I   A   N   L   A   G   V   I   S   A aacaccatcaacacggatgtgatccaccataatggcttggccgagtacgacacgcacaac
 N   T   I   N   T   D   V   I   H   H   N   G   L   A   E   Y   D   T   H   N ctgtacggcaccatgatgtcgacggcgagcagaatcgccatggagaagcgccgacctggc
 L   Y   G   T   M   M   S   T   A   S   R   I   A   M   E   K   R   R   P   G aggagaccgctggtaatcacccgcagcacctttgcaggcgctggggggacgtagggcac
 R   R   P   L   V   I   T   R   S   T   F   A   G   A   G   R   D   V   G   H tggctaggggataatctttcggattgggagcattacagattctcgatttcccaacttctt
 W   L   G   D   N   L   S   D   W   E   H   Y   R   F   S   I   S   Q   L   L cagtttgccgctctgtaccaggtgcctatggttggctctgatgtctgtgggttcgggtcc
 Q   F   A   A   L   Y   Q   V   P   M   V   G   S   D   V   C   G   F   G   S aacacaacggagactttgtgcgcgagatgggcgctgctgggagcattttctacgttctac
 N   T   T   E   T   L   C   A   R   W   A   L   L   G   A   F   S   T   F   Y aggaatcacaatcaggacaacgcaatttcgcaggaattctacaggtggccgctggtgacg
 R   N   H   N   Q   D   N   A   I   S   Q   E   F   Y   R   W   P   L   V   T
```

```
gaggcggccaagaatgcaatcagcatacggtaccagctgcttgactacatctacaccgcc
 E  A  A  K  N  A  I  S  I  R  Y  Q  L  L  D  Y  I  Y  T  A ttccaacggcagactcaaacgggtgagccagtggtcaacccgctattcttcaactatcca
 F  Q  R  Q  T  Q  T  G  E  P  V  V  N  P  L  F  F  N  Y  P accgacgcaaacacgttcggcatcgatttgcagtacttttacggagactcgattctcgtg
 T  D  A  N  T  F  G  I  D  L  Q  Y  F  Y  G  D  S  I  L  V agcccggtgacggaagagaacgtaactacggtcgacatctacctgccagatgacatcttt
 S  P  V  T  E  E  N  V  T  T  V  D  I  Y  L  P  D  D  I  F tacgacttccacaccggcgagacggtgcgagggaacggctcgttcatcacgctccctgac
 Y  D  F  H  T  G  E  T  V  R  G  N  G  S  F  I  T  L  P  D gtcccatacacgaccattcccctgcacgtgaggggaggcagcatcatcccgctgcgagcg
 V  P  Y  T  T  I  P  L  H  V  R  G  G  S  I  I  P  L  R  A gcatcagccaacacgacgacggagctgcgaaagcagaatttcacgctgctcattgctccc
 A  S  A  N  T  T  T  E  L  R  K  Q  N  F  T  L  L  I  A  P ggtttggacggcacagccagtggcagcctgtacctggatgagggcgatgcgatcgcgcag
 G  L  D  G  T  A  S  G  S  L  Y  L  D  E  G  D  A  I  A  Q ccggccacgtcggagattcaattcaactacgacgggcagaagctggtgctgagcggatcg
 P  A  T  S  E  I  Q  F  N  Y  D  G  Q  K  L  V  L  S  G  S tttggatacaattcggggtggtgataagcggggtgcgggtgctgggatcgtctggcaac
 F  G  Y  N  S  G  V  V  I  S  G  V  R  V  L  G  S  S  G  N ggcacaacatcagcgggcaggatcatggcagctaaggcgccactgtcgattgcgctcgac
 G  T  T  S  A  G  R  I  M  A  A  K  A  P  L  S  I  A  L  D tcggcggcagagatagcattgtag
 S  A  A  E  I  A  L  -

SEQ ID NO: 120
LENGTH: 887
TYPE: PRT
ORGANISM: M. phaseolina
MLLDRLPLVAAFGSVCSAGAISVRQSSSGVDSCPGYTASNVVDSGTTLTADLSLAGASCNAYGDDLTDLKLNV

EYQTANRLHVQIYDAAENVYQVPESVLPRPNAGNGSAAASAIQFKWVENPFSFSVVRTATNETLFDTADSPLV

FETQYWRLRTKLPSEPNLYGLGEHSDSFRLNTTNYTRTIWNRDAYGVPPGSNLYGAHPVYFDHRGPSGTHGVF

LLNSNGIEAKINNTDGQYLEYNVLGGIVDLYFLAGPTPKDVSKQYAEVVGLPAMQAYWAFGFHQCRYGYRDVY

DVAEVVANYSLAGIPLETMWTDIDYMDLRKVFTLDPARFPLELVRELVNYLHAHQQHYIVMVDPAVAYRNNTA

YDIGDQQDVFLKVSNGSYFIGVVWPGPTVFPDWFHPNTQPYWDDQFASFFSADTGVDIDALWIDMNEAANFCV

FPCSDPFGYAEANNQPPDPPPVRANSGRPIPGFPANFQPGGVTPPSRVRTRRQTAGTKAGLPGRDLLNPEYTI

ANLAGVISANTINTDVIHHNGLAEYDTHNLYGTMMSTASRIAMEKRRPGRRPLVITRSTFAGAGRDVGHWLGD

NLSDWEHYRFSISQLLQFAALYQVPMVGSDVCGFGSNTTETLCARWALLGAFSTFYRNHNQDNAISQEFYRWP

LVTEAAKNAISIRYQLLDYIYTAFQRQTQTGEPVVNPLFFNYPTDANTFGIDLQYFYGDSILVSPVTEENVTT

VDIYLPDDIFYDFHTGETVRGNGSFITLPDVPYTTIPLHVRGGSIIPLRAASANTTTELRKQNFTLLIAPGLD

GTASGSLYLDEGDAIAQPATSEIQFNYDGQKLVLSGSFGYNSGVVISGVRVLGSSGNGTTSAGRIMAAKAPLS

IALDSAAEIAL*

SEQ ID NO: 121
LENGTH: 2525 (including 150 bp 5' UTR and 150 bp 3' UTR)
TYPE: DNA
ORGANISM: M. phaseolina
CGGGTTGCTGCCTCTCGCTCGGCCTGCACAGCACCGACTCCATCAAATTATCCGCCGGCCGCCTACCGCGCTA

CATAAACCGATTACCGCCTTCATCATGTCTTTCTTCGGGAAGCGCGTGCGCCGGACCTACCGAGAGCTCGAGA

AAGCATGCGCTGGGCGGCTTTCCTGCTTCCGCCAGCAGCCATTGGAGCTGCTGCGCAACATGCCATCTCCGTC

CTAACCCCGGATCCCTACACCCTCACCATCACACACAAAAACGAGACCGTCCTGGAAAGCATCAGGATCCTCA

CCGGGACCTTCAACTACACTGCCGACTTCGTCTCAGCATCCGACGCCGGCGACATAGCCAATGCAGGCGGACG

CATCACCAGCAATTTCGTGAGCGACACAGTTGCGAAAATCCAGATCAACGCCAACAACCCCTACGTGGGCGCT
```

-continued

```
GACATCGGAGCTGGCTCGGACGCATTGCGTTACGGTGTCTGGGAGTATCCTTGGGACGGTAAGGTTGCCAACG
AGAATGTGACTTTCGAGATCAAGGGAATTGGGGAGGCAACTGGCGTGAACTGGTCCAATGCTCGTAGGTCGCT
GGAGTTCGAGCAACCATCCACTGGGCGTTGCTAACCGTCTCAGGGGCTCCTTTCTTCTTGTCCAGTGCGGGCT
ATGGCATATACATCGACACTCTCGCCATGGGCCTCTTTGATTTCAGCAATTCTGGGAGCACCCGCTTCGTCTT
CAATGCCACCAGTTTGACCGTCTACGCCATTTTGCCGACCGCCCCGGGCGACTACAAGTCCATTCTCACGCAG
TACGCCAAGCTGTCATCCTACATCTATATGCCGCCCGATACCGCATACGGGCCCATCGTCTACTCCGACAACT
GGGAGACCGATTTCCACGGCGATGTATCCAACGCCCAAGAGAACTACTACGACGTCGTCGACCATCTCTTCGA
CAATCACATCCGTGCAAGCGCCATGTTCGCCGATCGCCCTTACGGCACCGGAAATGGCTCTTGGGGCAACTTC
GACTTCAATCTCACCGCGTATCCCACTCCCGCAGACTTCATCGCCAACCTCTCTGACTGGGGATACGATTTCC
AGGCATGGGTTGCCAACCGCGCCACGCCCGGTACGGTCCTCTGGAATGCTTCAGTTGTCAATAACTGGCAATT
CGAATTCGACTATGCAACGCTGCAGGGCGGTCTCGCTGGCCCAGCCCTCAATCTCTCCATCCCTGAAGCATAC
GCTTTTTTCTCCGACCACCTGCAAGCCTTCACCGATCTCGGCGTCCGCGGGTACAAAATCGACCGTGGAGAAG
AAGAAGAGATGCCGGTTTGGGAGCAAAACATCCAGATGTCCCTGTTCGAGGAACTCTGTTACGCCAACATGTT
ATCCGCCTGGGGTGAAGGCAACTTCTTCTCCTTCGCTCGCTCCGTCTTCGACCGTTCCCGCAGCCACGCCGCA
GTCTGGAACGGAGACGCGCATGCCAACTTCACAGGATTGGCCTACAGTGTCGCCAGCGGTATTCGTGCTGGAC
TTTTGGGCTTCTCCATGTGGGGTTCCGATACTGGCGGCTACATACGGGAGGGTGAGGAGCCTGTCCCGACAGA
AGAGGTGTGGGCGCGTTGGATGCATTTTGCTACCTTCAGCCCCATGTATGAGCTCATGCTCGGAACCGGTGCG
ACTCCCTGGTATGCGCCGTATACCTCAGATCTGGTTGCTGTCTTCAGAGAGACTGCGGATCTACATCATCAAC
TTCTGCCGTACATCCGCAGCTACACTTACGCCGCGCATACTACTGGCCTGCCCGTCATGCGTGCTCTATTCCT
CGAGGAGCCAGCCGATGAGGCCTCTTGGATTCATTCCGATAACGAGTACTTCTTCGGTGCAGAGCTGCTTGTG
GCTCCGGTTGTGACGGCTGGGGGCACGCGAGATGTCTACTTCCCCGGCTCAAATGAGACGCTTTATCTCGAGT
ACCTGAACAAGAGCAGCGTTTACCGGGGTGGCGAGACGGTGTCCGTGGAGCTTGGCGTCCATGATGTACCTGT
ATACGTCAAAGCAGGCGCCATTATTCCACGTGGGGACATCTTCAGGGCAAATGATCGGTGGACTGAAGACTGG
AAACCATATCTAGACCTCGAGGTGTTCCCATCGTTTGATATTCCCAAGTCTCAGTTCAAGTACTTCAACAAGG
AGAAGAATGTGACGGTTGATATAACGTTGACAATGGACGATAAGAAGGCAGAGGTGGAGTATGGCGAGCTGGG
TTTCAATGGCACAGTGCTTTTCTATTTGAAGGATGGTGTGAAGAAGGTAGACATCACTCCAAGAGGCGGGGGA
GCGATCGTATATGGCGCCCAGTCACTGTTCAAAGTGTAACGACAAAGAATCAGAGAGAGTCTGATAAGTGAAT
TCCGGTACCTGGTAGTGATCTGTATTCAATTATCTGCCCTCTATCCTGCGACTGCTCACAATTCCAACTCCGT
CCAGAGCGCACTCCTGTCTCTCTATTTCCCTTACAAACTTCCG
```

SEQ ID NO: 122
LENGTH: 2172
TYPE: DNA
ORGANISM: M. phaseolina
FEATURE NAME/KEY: CDS
LOCATION: (1)...(2172)

```
atgcgctgggcggctttcctgcttccgccagcagccattggagctgctgcgcaacatgcc
 M  R  W  A  A  F  L  L  P  P  A  A  I  G  A  A  A  Q  H  A atctccgtcctaaccccggatccctacaccctcaccatcacacacaaaaacgagaccgtc
 I  S  V  L  T  P  D  P  Y  T  L  T  I  T  H  K  N  E  T  V ctggaaagcatcaggatcctcaccgggaccttcaactacactgccgacttcgtctcagca
 L  E  S  I  R  I  L  T  G  T  F  N  Y  T  A  D  F  V  S  A tccgacgccggcgacatagccaatgcaggcggacgcatcaccagcaatttcgtgagcgac
 S  D  A  G  D  I  A  N  A  G  G  R  I  T  S  N  F  V  S  D acagttgcgaaaatccagatcaacgccaacaaccctacgtgggcgctgacatcggagct
 T  V  A  K  I  Q  I  N  A  N  N  P  Y  V  G  A  D  I  G  A ggctcggacgcattgcgttacggtgtctgggagtatccttgggacggtaaggttgccaac
 G  S  D  A  L  R  Y  G  V  W  E  Y  P  W  D  G  K  V  A  N
```

-continued

```
gagaatgtgactttcgagatcaagggaattggggaggcaactggcgtgaactggtccaat
 E  N  V  T  F  E  I  K  G  I  G  E  A  T  G  V  N  W  S  N gctcgggctcctttcttcttgtccagtgcgggctatggcatatacatcgacactctcgcc
 A  R  A  P  F  F  L  S  S  A  G  Y  G  I  Y  I  D  T  L  A atgggcctcttgatttcagcaattctgggagcaccgcttcgtcttcaatgccaccagt
 M  G  L  F  D  F  S  N  S  G  S  T  R  F  V  F  N  A  T  S ttgaccgtctacgccattttgccgaccgcccgggcgactacaagtccattctcacgcag
 L  T  V  Y  A  I  L  P  T  A  P  G  D  Y  K  S  I  L  T  Q tacgccaagctgtcatcctacatctatatgccgcccgataccgcatacgggcccatcgtc
 Y  A  K  L  S  S  Y  I  Y  M  P  P  D  T  A  Y  G  P  I  V tactccgacaactgggagaccgatttccacggcgatgtatccaacgcccaagagaactac
 Y  S  D  N  W  E  T  D  F  H  G  D  V  S  N  A  Q  E  N  Y tacgacgtcgtcgaccatctcttcgacaatcacatccgtgcaagcgccatgttcgccgat
 Y  D  V  V  D  H  L  F  D  N  H  I  R  A  S  A  M  F  A  D cgcccttacggcaccggaaatggctcttggggcaacttcgacttcaatctcaccgcgtat
 R  P  Y  G  T  G  N  G  S  W  G  N  F  D  F  N  L  T  A  Y cccactcccgcagacttcatcgccaacctctctgactggggatacgatttccaggcatgg
 P  T  P  A  D  F  I  A  N  L  S  D  W  G  Y  D  F  Q  A  W gttgccaaccgcgccacgcccggtacggtcctctggaatgcttcagttgtcaataactgg
 V  A  N  R  A  T  P  G  T  V  L  W  N  A  S  V  V  N  N  W caattcgaattcgactatgcaacgctgcagggcggtctcgctggcccagccctcaatctc
 Q  F  E  F  D  Y  A  T  L  Q  G  G  L  A  G  P  A  L  N  L tccatccctgaagcatacgctttttctccgaccacctgcaagccttcaccgatctcggc
 S  I  P  E  A  Y  A  F  F  S  D  H  L  Q  A  F  T  D  L  G gtccgcgggtacaaaatcgaccgtggagaagaagaagagatgccggtttgggagcaaaac
 V  R  G  Y  K  I  D  R  G  E  E  E  E  M  P  V  W  E  Q  N atccagatgtccctgttcgaggaactctgttacgccaacatgttatccgcctggggtgaa
 I  Q  M  S  L  F  E  E  L  C  Y  A  N  M  L  S  A  W  G  E ggcaacttcttctccttcgctcgctccgtcttcgaccgttcccgcagccacgccgcagtc
 G  N  F  F  S  F  A  R  S  V  F  D  R  S  R  S  H  A  A  V tggaacggagacgcgcatgccaacttcacaggattggcctacagtgtcgccagcggtatt
 W  N  G  D  A  H  A  N  F  T  G  L  A  Y  S  V  A  S  G  I cgtgctggacttttgggcttctccatgtggggttccgatactggcggctacatacgggag
 R  A  G  L  L  G  F  S  M  W  G  S  D  T  G  G  Y  I  R  E ggtgaggagcctgtcccgacagaagaggtgtgggcgcgttggatgcattttgctaccttc
 G  E  E  P  V  P  T  E  E  V  W  A  R  W  M  H  F  A  T  F agccccatgtatgagctcatgctcggaaccggtgcgactccctggtatgcgccgtatacc
 S  P  M  Y  E  L  M  L  G  T  G  A  T  P  W  Y  A  P  Y  T tcagatctggttgctgtcttcagagagactgcggatctacatcatcaacttctgccgtac
 S  D  L  V  A  V  F  R  E  T  A  D  L  H  H  Q  L  L  P  Y atccgcagctacacttacgccgcgcatactactggcctgcccgtcatgcgtgctctattc
 I  R  S  Y  T  Y  A  A  H  T  T  G  L  P  V  M  R  A  L  F ctcgaggagccagccgatgaggcctcttggattcattccgataacgagtacttcttcggt
 L  E  E  P  A  D  E  A  S  W  I  H  S  D  N  E  Y  F  F  G gcagagctgcttgtggctccggttgtgacggctggggcacgcgagatgtctacttcccc
 A  E  L  L  V  A  P  V  V  T  A  G  G  T  R  D  V  Y  F  P ggctcaaatgagacgctttatctcgagtacctgaacaagagcagcgtttaccgggggtggc
 G  S  N  E  T  L  Y  L  E  Y  L  N  K  S  S  V  Y  R  G  G gagacggtgtccgtggagcttggcgtccatgatgtacctgtatacgtcaaagcaggcgcc
 E  T  V  S  V  E  L  G  V  H  D  V  P  V  Y  V  K  A  G  A attattccacgtggggacatcttcagggcaaatgatcggtggactgaagactggaaacca
 I  I  P  R  G  D  I  F  R  A  N  D  R  W  T  E  D  W  K  P tatctagacctcgaggtgttcccatcgtttgatattcccaagtctcagttcaagtacttc
 Y  L  D  L  E  V  F  P  S  F  D  I  P  K  S  Q  F  K  Y  F
```

```
aacaaggagaagaatgtgacggttgatataacgttgacaatggacgataagaaggcagag
 N  K  E  K  N  V  T  V  D  I  T  L  T  M  D  D  K  K  A  E gtggagtatggcgagctgggtttcaatggcacagtgcttttctatttgaaggatggtgtg
 V  E  Y  G  E  L  G  F  N  G  T  V  L  F  Y  L  K  D  G  V aagaaggtagacatcactccaagaggcggggagcgatcgtatatggcgcccagtcactg
 K  K  V  D  I  T  P  R  G  G  G  A  I  V  Y  G  A  Q  S  L ttcaaagtgtaa
 F  K  V  -

SEQ ID NO: 123
LENGTH: 723
TYPE: PRT
ORGANISM: M. phaseolina
MRWAAFLLPPAAIGAAAQHAISVLTPDPYTLTITHKNETVLESIRILTGTFNYTADFVSASDAGDIANAGGRI

TSNFVSDTVAKIQINANNPYVGADIGAGSDALRYGVWEYPWDGKVANENVTFEIKGIGEATGVNWSNARAPFF

LSSAGYGIYIDTLAMGLFDFSNSGSTRFVFNATSLTVYAILPTAPGDYKSILTQYAKLSSYIYMPPDTAYGPI

VYSDNWETDFHGDVSNAQENYYDVVDHLFDNHIRASAMFADRPYGTGNGSWGNFDFNLTAYPTPADFIANLSD

WGYDFQAWVANRATPGTVLWNASVVNNWQFEFDYATLQGGLAGPALNLSIPEAYAFFSDHLQAFTDLGVRGYK

IDRGEEEEMPVWEQNIQMSLFEELCYANMLSAWGEGNFFSFARSVFDRSRSHAAVWNGDAHANFTGLAYSVAS

GIRAGLLGFSMWGSDTGGYIREGEEPVPTEEVWARWMHFATFSPMYELMLGTGATPWYAPYTSDLVAVFRETA

DLHHQLLPYIRSYTYAAHTTGLPVMRALFLEEPADEASWIHSDNEYFFGAELLVAPVVTAGGTRDVYFPGSNE

TLYLEYLNKSSVYRGGETVSVELGVHDVPVYVKAGAIIPRGDIFRANDRWTEDWKPYLDLEVFPSFDIPKSQF

KYFNKEKNVTVDITLTMDDKKAEVEYGELGENGTVLFYLKDGVKKVDITPRGGGAIVYGAQSLFKV*

SEQ ID NO: 124
LENGTH: 2594 (including 150 bp 5' UTR and 150 bp 3' UTR)
TYPE: DNA
ORGANISM: M. phaseolina
GGCTGAGTATGTTTTGACAGGCATTAGGACGTCATTGCTCACCAGATCTCGCGGGATGCTCACCGTACTCGGA

CATAAATTGAACGACAGCAGGCCATTGGTGCAGCAGACGAGCTCGCCTGGCACGTCGTCATATCACCATCCAC

CATAATGCATCTTCTCTATAGTCTCGTCTCCTTGCCTCTTCTCACTGTTTCTGCCCAGAATATCACTTCGGAG

TACTTCGCACCGAACTCTACGGGCTTTCGTATGACACATGGGTTCGAGACTATTCTCGTCCAACCGTACGGTT

ACGATGGCTTTCGTGTCAGAGCATGGCCCTTCCGGCCTCCAAACGGCAATGAGATCAGCTTCCTCTATGATCC

GCCACTTGAAGGGCCTGAGAATGGAGAAGCCCGAGCAATGAGCTATGATTTCACTACCAATGGCAATCAGAGC

GCCATCATTCGCAATGGTAACACCGTCGTCAAGACATACGGCCTCGAGGGTGCTCACTACCGTCTGGCCTTCT

ACCGCATCGAGCCTGATGGGACAGAAACGCTACTCACGAATGAGTTCAACCCGGTCAAGGCTCTCAACCCCAG

ATACTACTCCTGGACCAGCACCGGGTACGAGTTCTCTGCCTCGTTTTCTTTCACTACAACTCCAGACGAACAG

ATATTCGGGACCGGCACTCAACAGGATTTTCTGCTGAACAAGAAAGGCTCCGTCATCGACATGATTAATTTCA

ACTCGTACATTCCGACTCCCGTTTTCATGTCCAGCAAGGGCTACGGATTTGTGTGGAACTCTGCCGCTCAAGG

CCGAATGGAGTTTGGGCCACGCCGCAACAAGTTCACGTCGGACTCCACAACGCTCGTCGACTATGCCATTGTC

AGTGCCCCGGAAGGCGACTACGATTCGCTCCAGCAGAAGCTCACTGCCATTACCGGCCGTGCGCCGACGCCTC

CTGACTTTTCCCTCGGCTACCTCCACTCGAAACTGCGGTACGAAAACCAAACGGAAGTCGTTCTTCTTGCTCA

GGGGTTCCGTGACCGCAATATCCCAGTCTCCATGATAGTCATTGACTACGAGTCCTGGGCTCAGAACGGTGAT

TGGGGGCTGGATCCTGCTCTCTGGCCGGATGTCGCTTCGATGGCGGCACAGGTCAAGAACTTGACTGGCGCGG

AGATGATGGCTTCGCTGTGGCCGGCGGTGGAAGATGATAGCCTGAACTACGCTGAGATGCAGCAGTTGGGCCT

GCTCGCAGCAACAATGTCGGGGCCGGGCACAACCGACTCGTGGAATGGCAGTTACATCAGGAACTACGACAGC

ACGAACCCGCGCGCCCGCGAGTTCCTGTGGAACACACTGAAGCGGAATTACTACGACAAGGGGATCAAGAACT

TCTGGATCGACCAAGCAGATGGCGGAGCTTTGGGAGAGGCGTGGGAGAACAACGGCCAGACCGCTTACGTTCA

ATCCATCCCGTATCCGCTGCCTCAGGTACTCTACCATGCCGGCACGCAGGCATCAGTTGGGAAGCTCTACCCT
```

-continued

```
TGGGCACACCAACAGGCCATTGAGGAAGGGACGCGCAATGCTACCGGGACTGAGCAAGGCACAGCGTAGGTCT
CACTGTTCCCCTGCCCTCTTAGACGCGAAGTGCCGGATTCTTCGTGCTGACATGACACAGCTGCGACTACATA
TCGCTCAGCCGCTCGGGCTACATCGGCTCGCAGCGCTTCTGCAGCATGATCTGGTCGGGCGACACCGAGGCCA
GCTGGGAGGTGCTGGGTAACCAGATCCCTAACGCGCTGAGCGCGGCGGCAACGGGGTGGTCGTGGTACACGGT
CGACGCGGGCGGCTTCCAGCCGGACCCTGCCATCGAGTGGTCCAACAACATCGACCGGCCCGAGTACCGCGAG
CTGTACGTGCGCTGGCTGCAGTGGACCACCTTCTTGCCCTTCATGCGCAACCACGGCTCGCGCGCCTGCGATG
TCCAGCACGCCTTCACCTGCGACAACGAGCCGTGGACGTACGGCGCCCAGAACACGCCGACCATCGTCTCGTA
CATCAACCTGCGCTACCGCCTCGCCCCCTACGTGCGCGCGCTGTTCGAGCAGCTCTCGCGCACAGGCAGGCAG
ATCCTGCGGCCGCTGTTCATGGACTTCGGCAAGAGCGATGCGAACGTCGTGGCCTGGACGAGGGAGAACAAGA
ACATCACGACGCAGCAGTACATGTTCGGCCCCGGCTGCTCGTCGCGCCTGTGGTGCTGCCGAACGTGACGAC
GTGGCCTGTGTATCTGCCCAAGACGGCGGGTGAGGGGAGTGGGCAGAGGCCGTGGACGTATTGGTGGACGAAC
GAGACGTTTGCGGGCGGGCAGACGGTGAACGTGAGCGCGCCGGTGGAACATATCCCCTTGTTCTACCTGGGTG
ATAGGGACGACATATTCTCCGGAAACGTGTTTTAGAATTGAGCGAAAAGGGTGGCAGTGAGTGAATGCGAAAT
GGCAATTCGAGTACATTGCCTCACGTATTTTGATGCCGATTTATTCTGAGAATATGCATTGCCATTGAACTAA
TCTACATATCCGCCCGACTAGTCTCGGACAAACTTCTGA
```

SEQ ID NO: 125
LENGTH: 2226
TYPE: DNA
ORGANISM: M. phaseolina
FEATURE NAME/KEY: CDS
LOCATION: (1)...(2226)

```
atgcatcttctctatagtctcgtctccttgcctcttctcactgtttctgcccagaatatc
 M  H  L  L  Y  S  L  V  S  L  P  L  L  T  V  S  A  Q  N  I acttcggagtacttcgcaccgaactctacgggctttcgtatgacacatggttcgagact
 T  S  E  Y  F  A  P  N  S  T  G  F  R  M  T  H  G  F  E  T attctcgtccaaccgtacggttacgatggctttcgtgtcagagcatggcccttccggcct
 I  L  V  Q  P  Y  G  Y  D  G  F  R  V  R  A  W  P  F  R  P ccaaacggcaatgagatcagcttcctctatgatccgccacttgaagggcctgagaatgga
 P  N  G  N  E  I  S  F  L  Y  D  P  P  L  E  G  P  E  N  G gaagcccgagcaatgage tatgatttcactaccaatggcaatcagagcgccatcattcgc
 E  A  R  A  M  S  Y  D  F  T  T  N  G  N  Q  S  A  I  I  R aatggtaacaccgtcgtcaagacatacggcctcgagggtgctcactaccgtctggccttc
 N  G  N  T  V  V  K  T  Y  G  L  E  G  A  H  Y  R  L  A  F taccgcatcgagcctgatgggacagaaacgctactcacgaatgagttcaacccggtcaag
 Y  R  I  E  P  D  G  T  E  T  L  L  T  N  E  F  N  P  V  K gctctcaaccccagatactactcctggaccagcaccgggtacgagttctctgcctcgttt
 A  L  N  P  R  Y  Y  S  W  T  S  T  G  Y  E  F  S  A  S  F tctttcactacaactccagacgaacagatattcgggaccggcactcaacaggattttctg
 S  F  T  T  T  P  D  E  Q  I  F  G  T  G  T  Q  Q  D  F  L ctgaacaagaaaggctccgtcatcgacatgattaatttcaactcgtacattccgactccc
 L  N  K  K  G  S  V  I  D  M  I  N  F  N  S  Y  I  P  T  P gttttcatgtccagcaagggctacggatttgtgtggaactctgccgctcaaggccgaatg
 V  F  M  S  S  K  G  Y  G  F  V  W  N  S  A  A  Q  G  R  M gagtttgggccacgccgcaacaagttcacgtcggactccacaacgctcgtcgactatgcc
 E  F  G  P  R  R  N  K  F  T  S  D  S  T  T  L  V  D  Y  A attgtcagtgccccggaaggcgactacgattcgctccagcagaagctcactgccattacc
 I  V  S  A  P  E  G  D  Y  D  S  L  Q  Q  K  L  T  A  I  T ggccgtgcgccgacgcctcctgacttttccctcggctacctccactcgaaactgcggtac
 G  R  A  P  T  P  P  D  F  S  L  G  Y  L  H  S  K  L  R  Y gaaaaccaaacggaagtcgttcttcttgctcaggggttccgtgaccgcaatatcccagtc
 E  N  Q  T  E  V  V  L  L  A  Q  G  F  R  D  R  N  I  P  V
```

```
tccatgatagtcattgactacgagtcctgggctcagaacggtgattgggggctggatcct
 S  M  I  V  I  D  Y  E  S  W  A  Q  N  G  D  W  G  L  D  P gctctctggccggatgtcgcttcgatggcggcacaggtcaagaacttgactggcgcggag
 A  L  W  P  D  V  A  S  M  A  A  Q  V  K  N  L  T  G  A  E atgatggcttcgctgtggccggcggtggaagatgatagcctgaactacgctgagatgcag
 M  M  A  S  L  W  P  A  V  E  D  D  S  L  N  Y  A  E  M  Q cagttgggcctgctcgcagcaacaatgtcggggccgggcacaaccgactcgtggaatggc
 Q  L  G  L  L  A  A  T  M  S  G  P  G  T  T  D  S  W  N  G agttacatcaggaactacgacagcacgaacccgcgcgcccgcgagttcctgtggaacaca
 S  Y  I  R  N  Y  D  S  T  N  P  R  A  R  E  F  L  W  N  T ctgaagcggaattactacgacaaggggatcaagaacttctggatcgaccaagcagatggc
 L  K  R  N  Y  Y  D  K  G  I  K  N  F  W  I  D  Q  A  D  G ggagctttgggagaggcgtgggagaacaacggccagaccgcttacgttcaatccatcccg
 G  A  L  G  E  A  W  E  N  N  G  Q  T  A  Y  V  Q  S  I  P tatccgctgcctcaggtactctaccatgccggcacgcaggcatcagttgggaagctctac
 Y  P  L  P  Q  V  L  Y  H  A  G  T  Q  A  S  V  G  K  L  Y ccttgggcacaccaacaggccattgaggaagggacgcgcaatgctaccgggactgagcaa
 P  W  A  H  Q  Q  A  I  E  E  G  T  R  N  A  T  G  T  E  Q ggcacagcctgcgactacatatcgctcagccgctcgggctacatcggctcgcagcgcttc
 G  T  A  C  D  Y  I  S  L  S  R  S  G  Y  I  G  S  Q  R  F tgcagcatgatctggtcgggcgacaccgaggccagctgggaggtgctgggtaaccagatc
 C  S  M  I  W  S  G  D  T  E  A  S  W  E  V  L  G  N  Q  I cctaacgcgctgagcgcggcggcaacggggtggtcgtggtacacggtcgacgcgggcggc
 P  N  A  L  S  A  A  A  T  G  W  S  W  Y  T  V  D  A  G  G ttccagccggaccctgccatcgagtggtccaacaacatcgaccggcccgagtaccgcgag
 F  Q  P  D  P  A  I  E  W  S  N  N  I  D  R  P  E  Y  R  E ctgtacgtgcgctggctgcagtggaccaccttcttgcccttcatgcgcaaccacggctcg
 L  Y  V  R  W  L  Q  W  T  T  F  L  P  F  M  R  N  H  G  S cgcgcctgcgatgtccagcacgccttcacctgcgacaacgagccgtggacgtacggcgcc
 R  A  C  D  V  Q  H  A  F  T  C  D  N  E  P  W  T  Y  G  A cagaacacgccgaccatcgtctcgtacatcaacctgcgctaccgcctcgcccccctacgtg
 Q  N  T  P  T  I  V  S  Y  I  N  L  R  Y  R  L  A  P  Y  V cgcgcgctgttcgagcagctctcgcgcacaggcaggcagatcctgcggccgctgttcatg
 R  A  L  F  E  Q  L  S  R  T  G  R  Q  I  L  R  P  L  F  M gacttcggcaagagcgatgcgaacgtcgtggcctggacgagggagaacaagaacatcacg
 D  F  G  K  S  D  A  N  V  V  A  W  T  R  E  N  K  N  I  T acgcagcagtacatgttcggccccggctgctcgtcgcgcctgtggtgctgccgaacgtg
 T  Q  Q  Y  M  F  G  P  R  L  L  V  A  P  V  V  L  P  N  V acgacgtggcctgtgtatctgcccaagacgggggtgaggggagtgggcagaggccgtgg
 T  T  W  P  V  Y  L  P  K  T  A  G  E  G  S  G  Q  R  P  W acgtattggtggacgaacgagacgtttgcgggcgggcagacggtgaacgtgagcgcgccg
 T  Y  W  W  T  N  E  T  F  A  G  G  Q  T  V  N  V  S  A  P gtggaacatatccccttgttctacctgggtgatagggacgacatattctccggaaacgtg
 V  E  H  I  P  L  F  Y  L  G  D  R  D  D  I  F  S  G  N  V ttttag
 F  -

SEQ ID NO: 126
LENGTH: 741
TYPE: PRT
ORGANISM: M. phaseolina
MHLLYSLVSLPLLTVSAQNITSEYFAPNSTGFRMTHGFETILVQPYGYDGFRVRAWPFRPPNGNEISFLYDPP

LEGPENGEARAMSYDFTTNGNQSAIIRNGNTVVKTYGLEGAHYRLAFYRIEPDGTETLLTNEFNPVKALNPRY

YSWTSTGYEFSASFSFTTTPDEQIFGTGTQQDFLLNKKGSVIDMINFNSYIPTPVFMSSKGYGFVWNSAAQGR

MEFGPRRNKFTSDSTTLVDYAIVSAPEGDYDSLQQKLTAITGRAPTPPDFSLGYLHSKLRYENQTEVVLLAQG
```

-continued

FRDRNIPVSMIVIDYESWAQNGDWGLDPALWPDVASMAAQVKNLTGAEMMASLWPAVEDDSLNYAEMQQLGLL

AATMSGPGTTDSWNGSYIRNYDSTNPRAREFLWNTLKRNYYDKGIKNFWIDQADGGALGEAWENNGQTAYVQS

IPYPLPQVLYHAGTQASVGKLYPWAHQQAIEEGTRNATGTEQGTACDYISLSRSGYIGSQRFCSMIWSGDTEA

SWEVLGNQIPNALSAAATGWSWYTVDAGGFQPDPAIEWSNNIDRPEYRELYVRWLQWTTFLPFMRNHGSRACD

VQHAFTCDNEPWTYGAQNTPTIVSYINLRYRLAPYVRALFEQLSRTGRQILRPLFMDFGKSDANVVAWTRENK

NITTQQYMFGPRLLVAPVVLPNVTTWPVYLPKTAGEGSGQRPWTYWWTNETFAGGQTVNVSAPVEHIPLFYLG

DRDDIFSGNVF*

SEQ ID NO: 127
LENGTH: 3385 (including 150 bp 5' UTR and 150 bp 3' UTR)
TYPE: DNA
ORGANISM: M. phaseolina
GCTCACCGCCTTGGCCATCACGTGCCGCCAAGCTCTCTCCGCGCTCCGGGGAAAGCTGTCATCTACGCCGAGG

GAGCTGTCTCGACTCCAACCACTGCTTCACTGCTCCAGACCTCGCTGCATCCGGACTGCAGCCTGGTATCGCC

CATCATGCCGTCCGCAGCACCCAAGTCCCGTCGTTGGACCTCTTTTTTGCTTGTCGTTGCTGTCGTTTGTCTT

CTGTTTACACCTGCAGGTACGCCGCCTCGCCCGAGAGCTTCCTGAGCTCCACTGCACGTCCACCCTGGCTGAC

AACCGCAACACAGCGTCCGTCAAACACGAGAATTTCAAGACCTGCAGCCAGTCCGGCTTCTGTAAGCGCAACA

GAGCCTTTGCCGATAATGCCCAAGAACTGTCCTCCGCCTGGCAATCGCCCTACACCCTCGACCCCGCCTCCAT

CGCCTTCAACCAGGGCCAATTGTCCGCTACAGTCCTCAAGAAGGTCAATGATAACGACCAGGTCCGCCTGCCA

CTTACCCTGACCTTCCTGGAGTCCGGCACCGCTCGGTTCACTCTCGATGAGGAGAAGCGGCAGAAGGGCGACA

TCGAGCTCCGCCATGACAGCAAGGCTCGCAAGGAGCGTTACAATGAAGCCGAGAAGTGGGCCATCGTTGGTGG

TCTTGATGTCAGCACCGGTGCTGCCATCAGCTCCGAGGCTGACGAGGGTGTGACCAAGGTCGTCTATGGTCCG

GGCGGCAAGTTTGAGGCTGTCATACATCACTCTCCCCTGGCCGTCGACTTCAAGCGTGACGGACAGACCCAAG

TCAAGTTCAATGACCGCGGCTTTCTCAACTTGGAGCACTGGAGGCCCAAGATTGAGAAAGAGAAAAaGGAAGG

CGAGGAGGGTGCTGCCGAGGAGGCCGCCCCCGAGCCTACCGAGGACGAGAGCACCTGGTGGGATGAGTCCTTT

GGTGGAAACACCGACTCCAAGCCAAGAGGACCTGAGGCTGTTGCTTTGGACATTACCTTCCCCGACTACGCCC

ACGTATACGGTATTCCCGAGCATGCCAGCTCTCTGTCCCTCAAGGAGACTCGGTAAGCTTTATTCTCAGACAC

TGCCAAGCTTCGGCTGACTTTCTTTAGTGGTGGTGACGGCGCCTACTCTGAGCCTTACCGACTCTACAATGCC

GATGTGTTCGAGTATGAGATGGACAGCCCTATGACTCTCTATGGATCCATCCCTTTCATGCAGGCACACCGCA

AGGACTCCACCGTCGGTGTCTTCTGGCTCAATGCTGCGGAGACCTGGGTCGACATCGTCAAGTCCAAGAGCGC

TGCCAACGCTCTCAGTCTCGGTGTTGCTGGCCATACTGACACCAAAACCCACTGGATCTCCGAAAGTGGTCTC

CTCGATGTCTTCGTTTTCCTTGGCCCTGAACCCAAGGATGTCATAAAGAGCTACAGCGAGCTGACCGGCTACA

CTCAGCTTCCCCAGGAGTTTGCCATTGCCTACCATCAGTGCAGGTGGAACTACGTCACTGATGAAGATGTCAT

GGACGTTGACCGCAAGTTCGACAAGCACAACATTCCGTATGATGTTATTTGGCTCGACATTGAGTACACTCAC

GAAAAGAAATACTTCACCTGGGACCCCATGACTTTCCCCAAGACCAAGGAAATGCACGACCAGCTTGATAAGC

ACGACCGTAAGCTTGTTGCTATTATTGATCCTCACATCAAGAACGTTGCCGATTATCCCATCGTTGAAGAGCT

CAAAAGCAAGGAACTTGCTGCTAAGAACAAGGATGGCAACCAGTACGAGGGTTGGTGCTGGCCTGGCTCTTCG

TACTGGGTCGACTGCTTCAACCCTGCCGCTGTCGATTGGTGGAAGAGCCTCTTCAAGTACGATAAATTCCAGG

GCTCTGCCCCGAACACCTTCATCTGGAACGACATGAATGAGCCTTCTGTCTTCAACGGCCCTGAGACCACCAT

GCCCAAGGACAACATGCACTTCGGCAACTGGGAACACCGTGATGTCCACAACATCAACGGCATGACATTCCAC

AATGCCACTTACGAAGCCATCATTGAGCGCAAGAAGGGTGAGGTTCGCCGCCCTTTTGTCCTTACTCGTTCCT

TCTATGCAGGTAGCCAGAGACTCGGCGCCATGTGGACCGGAGACAACCAGGCCAACTGGGATCACCTCGCGGC

CTCGATTCCCATGACCCTCAACCAGGGCATTTCGGGCTTCCCTTTCGCTGGCGCTGATGTTGGTGGTTTTTTC

GGCAATCCGGAGAAGGATCTCCTGACCCGTTGGTACCAAGCAGGTGCCTTCTATCCCTTCTTCCGTGGTCACG

-continued

```
CCCACATTGATACCCGCCGCCGTGAGCCCTATCTGGCCGGCTCTCCCTACACTGAGATCATCACTCAGGCTCT
CCGCCTACGCTACTCTCTCATGCCGACCTGGTACACTGCCTTCCACGAGGCCAGTGTCAACGGTGCTCCCATT
ATCCGCCCCAACTACTACGTCCACCCCACTGATGAGAAGGGTTTTGCCATTGATGACCAGCTTTACCTGGGTT
CGACTGGCCTCCTCGCCAAGCCCGTTGTCACGGAGGGTGCTGACAGCGTTGACATTTATATCGCCGACGATGA
GCCTTACTACGACTACTTTGACTACACTATCTACACTGGCCCGGGCAGCAAGTCTATTCCTGCGCCTCTCGAG
AAGATCCCTCTCCTCATGCAGGGCGGTCACATCATCCCCCGCCGCGACCGTCCGCGCCGCAGCTCCGGCCTCA
TGAAGTACGACCCCTACACGCTAGTCGTGACCATTGGCAAGGACGGCAAAGCTGAGGGCGAGCTCTACGTTGA
CGACGGCGAGACGTTCGACTACCAGCAGGGTGCCTACATCTACCGCCGCTTCTTGTTCGACAAGCCCACCCAC
GCCCTCACCTCCATCGACATTTCCACTTCTGGCCCCAAGACAGCTACGTATCTCAAGAGTATGGCAAAGGTTC
GCGTTGAAAAGGTCGTCATTGTCGGCGCCCCTGATGAGTGGGAGAGATTGGAGAGTGTGTTTGTAAGTGAGGA
AGGCGCAAAGGAGAGCCAGAGGAGGAGGAAGGTTCCGATTAAGTTCACCAAGGGTAAGGATGGTAAAGCCAGC
TTTGCGGTGGTAAGGGATCCGAAGGTCAGTATCGCGAAAGGCTGGAAGATTGATTTTGGTGGTGAGAACGAGG
AGCATCATGGGCATGCTCATTAGACGGCTTGGAAAGGGAATGGAAAGAGATGGTGTGGAAGATGTGGAATTGG
GAAAAGGGTCATGATAGATATGATGCATTGTCTGTGAGAATTTTAGAGGCGTGTCTTTGTTGTACTGCGGGT
GTTTCCGTGTTTCGATTGGTTGAGCGG
```

```
SEQ ID NO: 128
LENGTH: 2967
TYPE: DNA
ORGANISM: M. phaseolina
FEATURE NAME/KEY: CDS
LOCATION: (1)...(2967)
atgccgtccgcagcacccaagtcccgtcgttggacctcttttttgcttgtcgttgctgtc
 M  P  S  A  A  P  K  S  R  R  W  T  S  F  L  L  V  V  A  V gtttgtcttctgtttacacctgcagcgtccgtcaaacacgagaatttcaagacctgcagc
 V  C  L  L  F  T  P  A  A  S  V  K  H  E  N  F  K  T  C  S cagtccggcttctgtaagcgcaacagagcctttgccgataatgcccaagaactgtcctcc
 Q  S  G  F  C  K  R  N  R  A  F  A  D  N  A  Q  E  L  S  S gcctggcaatcgccctacaccctcgaccccgcctccatcgccttcaaccagggccaattg
 A  W  Q  S  P  Y  T  L  D  P  A  S  I  A  F  N  Q  G  Q  L tccgctacagtcctcaagaaggtcaatgataacgaccaggtccgcctgccacttaccctg
 S  A  T  V  L  K  K  V  N  D  N  D  Q  V  R  L  P  L  T  L accttcctggagtccggcaccgctcggttcactctcgatgaggagaagcggcagaagggc
 T  F  L  E  S  G  T  A  R  F  T  L  D  E  E  K  R  Q  K  G gacatcgagctccgccatgacagcaaggctcgcaaggagcgttacaatgaagccgagaag
 D  I  E  L  R  H  D  S  K  A  R  K  E  R  Y  N  E  A  E  K tgggccatcgttggtggtcttgatgtcagcaccggtgctgccatcagctccgaggctgac
 W  A  I  V  G  G  L  D  V  S  T  G  A  A  I  S  S  E  A  D gagggtgtgaccaaggtcgtctatggtccgggcggcaagtttgaggctgtcatacatcac
 E  G  V  T  K  V  V  Y  G  P  G  G  K  F  E  A  V  I  H  H tctcccctggccgtcgacttcaagcgtgacggacagacccaagtcaagttcaatgaccgc
 S  P  L  A  V  D  F  K  R  D  G  Q  T  Q  V  K  F  N  D  R ggctttctcaacttggagcactggaggcccaagattgagaaagagaaaaaggaaggcgag
 G  F  L  N  L  E  H  W  R  P  K  I  E  K  E  K  K  E  G  E gagggtgctgccgaggaggccgccccgagcctaccgaggacgagagcacctggtgggat
 E  G  A  A  E  E  A  A  P  E  P  T  E  D  E  S  T  W  W  D gagtcctttggtggaaacaccgactccaagccaagaggacctgaggctgttgctttggac
 E  S  F  G  G  N  T  D  S  K  P  R  G  P  E  A  V  A  L  D attaccttccccgactacgcccacgtatacggtattcccgagcatgccagctctctgtcc
 I  T  F  P  D  Y  A  H  V  Y  G  I  P  E  H  A  S  S  L  S ctcaaggagactcgtggtggtgacggcgcctactctgagccttaccgactctacaatgcc
 L  K  E  T  R  G  G  D  G  A  Y  S  E  P  Y  R  L  Y  N  A
```

```
-continued
gatgtgttcgagtatgagatggacagccctatgactctctatggatccatcccttcatg
 D  V  F  E  Y  E  M  D  S  P  M  T  L  Y  G  S  I  P  F  M caggcacaccgcaaggactccaccgtcggtgtcttctggctcaatgctgcggagacctgg
 Q  A  H  R  K  D  S  T  V  G  V  F  W  L  N  A  A  E  T  W gtcgacatcgtcaagtccaagagcgctgccaacgctctcagtctcggtgttgctggccat
 V  D  I  V  K  S  K  S  A  A  N  A  L  S  L  G  V  A  G  H actgacaccaaaacccactggatctccgaaagtggtctcctcgatgtcttcgttttcctt
 T  D  T  K  T  H  W  I  S  E  S  G  L  L  D  V  F  V  F  L ggccctgaacccaaggatgtcataaagagctacagcgagctgaccggctacactcagctt
 G  P  E  P  K  D  V  I  K  S  Y  S  E  L  T  G  Y  T  Q  L ccccaggagtttgccattgcctaccatcagtgcaggtggaactacgtcactgatgaagat
 P  Q  E  F  A  I  A  Y  H  Q  C  R  W  N  Y  V  T  D  E  D gtcatggacgttgaccgcaagttcgacaagcacaacattccgtatgatgttatttggctc
 V  M  D  V  D  R  K  F  D  K  H  N  I  P  Y  D  V  I  W  L gacattgagtacactcacgaaaagaaatacttcacctgggaccccatgactttccccaag
 D  I  E  Y  T  H  E  K  K  Y  F  T  W  D  P  M  T  F  P  K accaaggaaatgcacgaccagcttgataagcacgaccgtaagcttgttgctattattgat
 T  K  E  M  H  D  Q  L  D  K  H  D  R  K  L  V  A  I  I  D cctcacatcaagaacgttgccgattatcccatcgttgaagagctcaaaagcaaggaactt
 P  H  I  K  N  V  A  D  Y  P  I  V  E  E  L  K  S  K  E  L gctgctaagaacaaggatggcaaccagtacgagggttggtgctggcctggctcttcgtac
 A  A  K  N  K  D  G  N  Q  Y  E  G  W  C  W  P  G  S  S  Y tgggtcgactgcttcaaccctgccgctgtcgattggtggaagagcctcttcaagtacgat
 W  V  D  C  F  N  P  A  A  V  D  W  W  K  S  L  F  K  Y  D aaattccagggctctgccccgaacaccttcatctggaacgacatgaatgagccttctgtc
 K  F  Q  G  S  A  P  N  T  F  I  W  N  D  M  N  E  P  S  V ttcaacggccctgagaccaccatgcccaaggacaacatgcacttcggcaactgggaacac
 F  N  G  P  E  T  T  M  P  K  D  N  M  H  F  G  N  W  E  H cgtgatgtccacaacatcaacggcatgacattccacaatgccacttacgaagccatcatt
 R  D  V  H  N  I  N  G  M  T  F  H  N  A  T  Y  E  A  I  I gagcgcaagaagggtgaggttcgccgcccttttgtccttactcgttccttctatgcaggt
 E  R  K  K  G  E  V  R  R  P  F  V  L  T  R  S  F  Y  A  G agccagagactcggcgccatgtggaccggagacaaccaggccaactgggatcacctcgcg
 S  Q  R  L  G  A  M  W  T  G  D  N  Q  A  N  W  D  H  L  A gcctcgattcccatgaccctcaaccagggcatttcgggcttccctttcgctggcgctgat
 A  S  I  P  M  T  L  N  Q  G  I  S  G  F  P  F  A  G  A  D gttggtggttttttcggcaatccggagaaggatctcctgacccgttggtaccaagcaggt
 V  G  G  F  F  G  N  P  E  K  D  L  L  T  R  W  Y  Q  A  G gccttctatcccttcttccgtggtcacgcccacattgatacccgccgcgtgagccctat
 A  F  Y  P  F  F  R  G  H  A  H  I  D  T  R  R  R  E  P  Y ctggccggctctccctacactgagatcatcactcaggctctccgcctacgctactctctc
 L  A  G  S  P  Y  T  E  I  I  T  Q  A  L  R  L  R  Y  S  L atgccgacctggtacactgccttccacgaggccagtgtcaacggtgctcccattatccgc
 M  P  T  W  Y  T  A  F  H  E  A  S  V  N  G  A  P  I  I  R cccaactactacgtccaccccactgatgagaagggttttgccattgatgaccagctttac
 P  N  Y  Y  V  H  P  T  D  E  K  G  F  A  I  D  D  Q  L  Y ctgggttcgactggcctcctcgccaagcccgttgtcacggagggtgctgacagcgttgac
 L  G  S  T  G  L  L  A  K  P  V  V  T  E  G  A  D  S  V  D atttatatcgccgacgatgagccttactacgactactttgactacactatctacactggc
 I  Y  I  A  D  D  E  P  Y  Y  D  Y  F  D  Y  T  I  Y  T  G ccgggcagcaagtctattcctgcgcctctcgagaagatccctctcctcatgcagggcggt
 P  G  S  K  S  I  P  A  P  L  E  K  I  P  L  L  M  Q  G  G cacatcatccccgccgcgaccgtccgcgccgcagctccggcctcatgaagtacgacccc
 H  I  I  P  R  R  D  R  P  R  R  S  S  G  L  M  K  Y  D  P
```

```
tacacgctagtcgtgaccattggcaaggacggcaaagctgagggcgagctctacgttgac
 Y  T  L  V  V  T  I  G  K  D  G  K  A  E  G  E  L  Y  V  D gacggcgagacgttcgactaccagcagggtgcctacatctaccgccgcttcttgttcgac
 D  G  E  T  F  D  Y  Q  Q  G  A  Y  I  Y  R  R  F  L  F  D aagcccaccacgccctcacctccatcgacatttccacttctggccccaagacagctacg
 K  P  T  H  A  L  T  S  I  D  I  S  T  S  G  P  K  T  A  T tatctcaagagtatggcaaaggttcgcgttgaaaaggtcgtcattgtcggcgcccctgat
 Y  L  K  S  M  A  K  V  R  V  E  K  V  V  I  V  G  A  P  D gagtgggagagattggagagtgtgtttgtaagtgaggaaggcgcaaaggagagccagagg
 E  W  E  R  L  E  S  V  F  V  S  E  E  G  A  K  E  S  Q  R aggaggaaggttccgattaagttcaccaagggtaaggatggtaaagccagctttgcggtg
 R  R  K  V  P  I  K  F  T  K  G  K  D  G  K  A  S  F  A  V gtaagggatccgaaggtcagtatcgcgaaaggctggaagattgattttggtggtgagaac
 V  R  D  P  K  V  S  I  A  K  G  W  K  I  D  F  G  G  E  N gaggagcatcatgggcatgctcattag
 E  E  H  H  G  H  A  H  -
```

SEQ ID NO: 129
LENGTH: 988
TYPE: PRT
ORGANISM: *M. phaseolina*

MPSAAPKSRRWTSFLLVVAVVCLLFTPAASVKHENFKTCSQSGFCKRNRAFADNAQELSSAWQSPYTLDPASI

AFNQGQLSATVLKKVNDNDQVRLPLTLTFLESGTARFTLDEEKRQKGDIELRHDSKARKERYNEAEKWAIVGG

LDVSTGAAISSEADEGVTKVVYGPGGKFEAVIHHSPLAVDFKRDGQTQVKFNDRGFLNLEHWRPKIEKEKKEG

EEGAAEEAAPEPTEDESTWWDESFGGNTDSKPRGPEAVALDITFPDYAHVYGIPEHASSLSLKETRGGDGAYS

EPYRLYNADVFEYEMDSPMTLYGSIPFMQAHRKDSTVGVFWLNAAETWVDIVKSKSAANALSLGVAGHTDTKT

HWISESGLLDVFVFLGPEPKDVIKSYSELTGYTQLPQEFAIAYHQCRWNYVTDEDVMDVDRKFDKHNIPYDVI

WLDIEYTHEKKYFTWDPMTFPKTKEMHDQLDKHDRKLVAIIDPHIKNVADYPIVEELKSKELAAKNKDGNQYE

GWCWPGSSYWVDCFNPAAVDWWKSLFKYDKFQGSAPNTFIWNDMNEPSVFNGPETTMPKDNMHFGNWEHRDVH

NINGMTFHNATYEAIIERKKGEVRRPFVLTRSFYAGSQRLGAMWTGDNQANWDHLAASIPMTLNQGISGFPFA

GADVGGFFGNPEKDLLTRWYQAGAFYPFFRGHAHIDTRRREPYLAGSPYTEIITQALRLRYSLMPTWYTAFHE

ASVNGAPIIRPNYYVHPTDEKGFAIDDQLYLGSTGLLAKPVVTEGADSVDIYIADDEPYYDYFDYTIYTGPGS

KSIPAPLEKIPLLMQGGHIIPRRDRPRRSSGLMKYDPYTLVVTIGKDGKAEGELYVDDGETFDYQQGAYIYRR

FLFDKPTHALTSIDISTSGPKTATYLKSMAKVRVEKVVIVGAPDEWERLESVFVSEEGAKESQRRRKVPIKFT

KGKDGKASFAVVRDPKVSIAKGWKIDFGGENEEHHGHAH*

SEQ ID NO: 130
LENGTH: 3383 (including 150 bp 5' UTR and 150 bp 3' UTR)
TYPE: DNA
ORGANISM: *M. phaseolina*

CGCAGCACTGCTTGGCCTGCTCTGGTGCTTATATTGTCTTGTTTCCCCTCCCCGGTCTTGGTCACGCACGCTC

CATTCGCACTCCAGCATCCCGTCTGAAGGGCCGGTCGTGTTTCCTTGGTCTACTCTTGTCCCAATCTCCTGTT

TCCAATGGCACCTTCGCCGCTGCCTGGCCTACGGGCACTGGCACGCTCGGTGCTGACCGTTGTGAGCATTGCT

CAGGCACAATCGAGTCTGTCTTCTTCAGCTGGGCAGGACGGAGTGGCCGCGTCTGCGACGACAGTCACGGCTT

CCGCCACCGCCTACCGCCCCAAGTTCACCGTTCCGGCTGACGCCGACGTCGGGCAAAACCTCATCCCCAACAT

CGAAGACCCGCAGGCCGTCGATGCCCAAACCGTTTGCCCGGGCTACAAGGCGTCCGGCGTGCGCCGAGATGCC

TACGGTTTCGCGGCAACCCTGAGCCTCGCCGGACATGCTTGCAATGTGTACGGCACCGATATCGAGACGTTGA

ACCTTACTGTGCAGTATCAGAACGCCGATCGCCTTGCCATCAACATTAGTCCGGCCAATATCGATGCCTCAAA

TTCGTCGCATTACATCCTCCCCGAGCAAGTCATTCCGCGGCCGGTCCTGGACGCCGATGCAGACTCGTCCATT

-continued

```
CGGGAAAACGACTTTCAGGTCGCCTGGAGCAACGACCCCAGCTTCTCTTTCACTGTCATTAGGCGGTCGACTG
GTGATGTGGTGTTCAGCACCGAAGGCAGTGTCCTGGTTTACGAGGATCAGTTCGTTGAGTTCGTAACTTCCAT
GCCCGCGGAATACAACATCTACGGCCTTGGAGAGCGCATCCATGGCCTGCGTCTCGGAACTAACTTCACCGCC
ACCATCTACGCTGCCGACGTTGGAGATCCCATTGATGACAACATCTATGGGAGCCACCCTTTCTACCTCGACA
CCAGATACTTCGAGGTCGATTCTGCTACTGGGAACTTGACCTACGTTTCCAACGCTCCTGATGCCGCCTCGAA
TGCTTCCTTTGTCTCCTACTCCCACGGCGTTTTCCTCCGCAACGCCCACGGTCAGGAGATTCTTCTCAGACCA
GACAACGTCACCTGGCGCACTCTCGGTGGTAGCATCGATCTTTTCTTCTTCGACGGCCCGTCCCAACCAGAGG
TCACGAAGCAGTACCAGCACGGCGCCGTCGGTCTTCCGGCAATGCAGCAGTACTTCACCTTTGGATACCATCA
GTGCCGCTGGGGATACGCCAATTGGTCCCAATTCGAGGAGGTTGTCGACAACTTCATCAAGTTCGAGATCCCG
CTGGAGAACATTTGGCTCGACATCGACTACATGCTGGAGTACAGGGATTTCACTTCCGACCCCAACACCTTCC
CCGTGAAAGAGGGTCTCGACGTGCTGCAGCGCCTGCATGATGGCGGACGGCATTTTATCCCCATTGTTGACAG
TGCTATCTACATTCCCAATCCGGAGAACGAGACCGATGCATATGCCACTTACACCAGGGGCAATGAGTCTGGA
GCCTTCCTGAAGAATCCCGACGGCAGTGAATACATCGGCGCCGTGTGGCCTGGTTACACCGTGTTCCCTGACT
GGTTGATCGACACGGCCGTTCCGTGGTGGTCCGACGAGCTGGTACGGTGGCACAAAGAGGTTCCCTTTGATGG
AATTTGGATCGACATGTCCGAGGTCTCTTCCTTCTGCGTCGGCTCCTGTGGCTCCGGTAACCTCTCGCTCAAC
CCTGCGCACCCTCCTTTCTCTCTCCCGGGTGAGCCAGGAAACGTCATCTATGATTACCCGGAGGGCTTCAACA
TCACGAACGCCACTGAAGCTGCGTCGGCTTCATCTGCTTCCTCTAGCCAAGCCGCAGCAACATCCTCTGCTGC
TTCAAGCTCAGGCACGACGAGCTATCTCCGGACTACTCCCACTCCTGGTGTGAGAAACGTCAACTACCCGCCT
TATGTCATTGACAATGTCCAGGGTGATCTGGCTGTGCATGCCGTTTCCCCTAATGCTACTCACTTCAATGGCG
TCGAAGAGTACGATGTGCATAATCTCTTCGGCCACCAGATCCTGAATGCCACATACCAAGGCCTGCTCGATGT
GTTTCCCGGGAAGAGGCCATTCATCATCGGCCGTTCCACATTTGCTGGATCCGGCAAGTGGGCCGGACACTGG
GGTGGCGACAAGTGAGTATATACACATATTCTACCGGAAGAAATCTTGACTGACATGGATTTCGCGCCAGCTA
CTCCAAATGGGCGTACATGTACTTCGGCATCCCGCAAGCTCTGTCCTTCAGTCTCTTCGGCATCCCCATGTTC
GGCGTCGACACGTGCGGCTTCAACGGCAATAGCGATGAGGAGCTGTGCAATCGGTGGATGCAGCTGTCCGCCT
tCTTTCCCTTCTACCGCAACCACAACACATTGAGCGCCAAATCGCAAGAGCCATACGTGTGGTCCTCGGTCAT
CGACGCGTCGAAGAAGGCCATGGCCATCCGCTACGCCCTGCTGCCCTACCTCTACACCCTCTTCCACGCCGCG
CATTCCACTGGCGCCACAGTCATGCGCGCCCTCGCCTGGGAGTTCCCAGACGACCCGTCCCTTGCCAACGTGG
ACACTCAGTTCCTCCTCGGCCCCAGCCTCCTCGTCACCCCCGTCCTCGCTCCCAACGCCTCCACTGTCCGCGG
CGTCTTTCCAGGCAGGGGCGCCGAGAAGTGGTACGACTGGTACTCGCAGCAGGTCGTTGACGTCTTGCCCGGC
GAGAACAAAACTCTCGACGCCCCGCTCGGCCATATTCCTGTCTTCGTGCGCGGCGGCAGCATATTGCCACTGC
AGGAACCGCGGCTCACGACGAAAGAGGCGCGGCGGACGCCGTGGGCGCTGCTGGTAGCGTTGGGCAAAGGCAG
CACGGCGAAGGGCGAGCTATACCTCGATGATGGAGAGAGCCTGAACCCGAATGAGACGCTGAGCGTGGCGTTC
GTGGCAGAGAGGGAGAGCTTGAGCGCGAGTGCGGTAGGGTTGTTCAGGGATGGGAATGCGTTGGCGAATGTGA
CGGTGCTGGGCGTTGCGAGCGAGCCCAGTGCTGTGAGGATTGGTGGCGTGGATGTTGGGAAGGGGAGGTGGGC
GTGGAGTAGGACGAGTAAGGTGTTGAGTGTTACGCGGTTGGATGAGGTGGTGAAGGGTGGGCGTGGGATGTG
GATTGGACGCTTACCTGGTAGAGGAGTTGGGTGGGTGCATTAGAAGGCCTCGAGACGGGTAGGCCAGGTGTTA
CTGCTTTTCATGACGGGGGGCTCTTTGAAAAGAGAAAGATGGCAATAGCACAAGAGCTTGGGAAGACGAGAA
GACGGAAAGGGAGATTGGACGAAAG
```

SEQ ID NO: 131
LENGTH: 3024
TYPE: DNA
ORGANISM: M. phaseolina
FEATURE NAME/KEY: CDS
LOCATION: (1)...(3024)

```
atggcaccttcgccgctgcctggcctacgggcactggcacgctcggtgctgaccgttgtg
 M  A  P  S  P  L  P  G  L  R  A  L  A  R  S  V  L  T  V  V agcattgctcaggcacaatcgagtctgtcttcttcagctgggcaggacggagtggccgcg
 S  I  A  Q  A  Q  S  S  L  S  S  S  A  G  Q  D  G  V  A  A tctgcgacgacagtcacggcttccgccaccgcctaccgccccaagttcaccgttccggct
 S  A  T  T  V  T  A  S  A  T  A  Y  R  P  K  F  T  V  P  A gacgccgacgtcgggcaaaacctcatccccaacatcgaagacccgcaggccgtcgatgcc
 D  A  D  V  G  Q  N  L  I  P  N  I  E  D  P  Q  A  V  D  A caaaccgtttgcccgggctacaaggcgtccggcgtgcgccgagatgcctacggtttcgcg
 Q  T  V  C  P  G  Y  K  A  S  G  V  R  R  D  A  Y  G  F  A gcaaccctgagcctcgccggacatgcttgcaatgtgtacggcaccgatatcgagacgttg
 A  T  L  S  L  A  G  H  A  C  N  V  Y  G  T  D  I  E  T  L aaccttactgtgcagtatcagaacgccgatcgccttgccatcaacattagtccggccaat
 N  L  T  V  Q  Y  Q  N  A  D  R  L  A  I  N  I  S  P  A  N atcgatgcctcaaattcgtcgcattacatcctccccgagcaagtcattccgcggccggtc
 I  D  A  S  N  S  S  H  Y  I  L  P  E  Q  V  I  P  R  P  V ctggacgccgatgcagactcgtccattcgggaaaacgactttcaggtcgcctggagcaac
 L  D  A  D  A  D  S  S  I  R  E  N  D  F  Q  V  A  W  S  N gaccccagcttctcttttcactgtcattaggcggtcgactggtgatgtggtgttcagcacc
 D  P  S  F  S  F  T  V  I  R  R  S  T  G  D  V  V  F  S  T gaaggcagtgtcctggtttacgaggatcagttcgttgagttcgtaacttccatgcccgcg
 E  G  S  V  L  V  Y  E  D  Q  F  V  E  F  V  T  S  M  P  A gaatacaacatctacggccttggagagcgcatccatggcctgcgtctcggaactaacttc
 E  Y  N  I  Y  G  L  G  E  R  I  H  G  L  R  L  G  T  N  F accgccaccatctacgctgccgacgttggagatcccattgatgacaacatctatgggagc
 T  A  T  I  Y  A  A  D  V  G  D  P  I  D  D  N  I  Y  G  S caccctttctacctcgacaccagatacttcgaggtcgattctgctactgggaacttgacc
 H  P  F  Y  L  D  T  R  Y  F  E  V  D  S  A  T  G  N  L  T tacgtttccaacgctcctgatgccgctcgaatgcttcctttgtctcctactcccacggc
 Y  V  S  N  A  P  D  A  A  S  N  A  S  F  V  S  Y  S  H  G gttttcctccgcaacgcccacggtcaggagattcttctcagaccagacaacgtcacctgg
 V  F  L  R  N  A  H  G  Q  E  I  L  L  R  P  D  N  V  T  W cgcactctcggtggtagcatcgatcttttcttcttcgacggcccgtcccaaccagaggtc
 R  T  L  G  G  S  I  D  L  F  F  F  D  G  P  S  Q  P  E  V acgaagcagtaccagcacggcgccgtcggtcttccggcaatgcagcagtacttcaccttt
 T  K  Q  Y  Q  H  G  A  V  G  L  P  A  M  Q  Q  Y  F  T  F ggataccatcagtgccgctggggatacgccaattggtcccaattcgaggaggttgtcgac
 G  Y  H  Q  C  R  W  G  Y  A  N  W  S  Q  F  E  E  V  V  D aacttcatcaagttcgagatcccgctggagaacatttggctcgacatcgactacatgctg
 N  F  I  K  F  E  I  P  L  E  N  I  W  L  D  I  D  Y  M  L gagtacagggatttcacttccgaccccaacacctttcccgtgaaagagggtctcgacgtg
 E  Y  R  D  F  T  S  D  P  N  T  F  P  V  K  E  G  L  D  V ctgcagcgcctgcatgatggcggacggcattttatccccattgttgacagtgctatctac
 L  Q  R  L  H  D  G  G  R  H  F  I  P  I  V  D  S  A  I  Y attcccaatccggagaacgagaccgatgcatatgccacttacaccaggggcaatgagtct
 I  P  N  P  E  N  E  T  D  A  Y  A  T  Y  T  R  G  N  E  S ggagccttcctgaagaatcccgacggcagtgaatacatcggcgccgtgtggcctggttac
 G  A  F  L  K  N  P  D  G  S  E  Y  I  G  A  V  W  P  G  Y accgtgttccctgactggttgatcgacacggccgttccgtggtggtccgacgagctggta
 T  V  F  P  D  W  L  I  D  T  A  V  P  W  W  S  D  E  L  V
```

-continued

```
cggtggcacaaagaggttccctttgatggaatttggatcgacatgtccgaggtctcttcc
 R  W  H  K  E  V  P  F  D  G  I  W  I  D  M  S  E  V  S  S ttctgcgtcggctcctgtggctccggtaacctctcgctcaaccckgcgcaccctcctttc
 F  C  V  G  S  C  G  S  G  N  L  S  L  N  P  A  H  P  P  F tctctcccgggtgagccaggaaacgtcatctatgattacccggagggcttcaacatcacg
 S  L  P  G  E  P  G  N  V  I  Y  D  Y  P  E  G  F  N  I  T aacgccactgaagctgcgtcggcttcatctgcttcctctagccaagccgcagcaacatcc
 N  A  T  E  A  A  S  A  S  S  A  S  S  S  Q  A  A  A  T  S tctgctgcttcaagctcaggcacgacgagctatctccggactactcccactcctggtgtg
 S  A  A  S  S  S  G  T  T  S  Y  L  R  T  T  P  T  P  G  V agaaacgtcaactacccgccttatgtcattgacaatgtccagggtgatctggctgtgcat
 R  N  V  N  Y  P  P  Y  V  I  D  N  V  Q  G  D  L  A  V  H gccgtttcccctaatgctactcacttcaatggcgtcgaagagtacgatgtgcataatctc
 A  V  S  P  N  A  T  H  F  N  G  V  E  E  Y  D  V  H  N  L ttcggccaccagatcctgaatgccacataccaaggcctgctcgatgtgtttcccgggaag
 F  G  H  Q  I  L  N  A  T  Y  Q  G  L  L  D  V  F  P  G  K aggccattcatcatcggccgttccacatttgctggatccggcaagtgggccggacactgg
 R  P  F  I  I  G  R  S  T  F  A  G  S  G  K  W  A  G  H  W ggtggcgacaactactccaaatgggcgtacatgtacttcggcatcccgcaagctctgtcc
 G  G  D  N  Y  S  K  W  A  Y  M  Y  F  G  I  P  Q  A  L  S ttcagtctcttcggcatccccatgttcggcgtcgacacgtgcggcttcaacggcaatagc
 F  S  L  F  G  I  P  M  F  G  V  D  T  C  G  F  N  G  N  S gatgaggagctgtgcaatcggtggatgcagctgtccgccttctttcccttctaccgcaac
 D  E  E  L  C  N  R  W  M  Q  L  S  A  F  F  P  F  Y  R  N cacaacacattgagcgccaaatcgcaagagccatacgtgtggtcctcggtcatcgacgcg
 H  N  T  L  S  A  K  S  Q  E  P  Y  V  W  S  S  V  I  D  A tcgaagaaggccatggccatccgctacgcccctgctgccctacctctacaccctcttccac
 S  K  K  A  M  A  I  R  Y  A  L  L  P  Y  L  Y  T  L  F  H gccgcgcattccactggcgccacagtcatgcgcgccctcgcctgggagttcccagacgac
 A  A  H  S  T  G  A  T  V  M  R  A  L  A  W  E  F  P  D  D ccgtcccttgccaacgtggacactcagttcctcctcggcccagcctcctcgtcacccc
 P  S  L  A  N  V  D  T  Q  F  L  L  G  P  S  L  L  V  T  P gtcctcgctcccaacgcctccactgtccgcggcgtctttccaggcaggggcgccgagaag
 V  L  A  P  N  A  S  T  V  R  G  V  F  P  G  R  G  A  E  K tggtacgactggtactcgcagcaggtcgttgacgtcttgcccggcgagaacaaaactctc
 W  Y  D  W  Y  S  Q  Q  V  V  D  V  L  P  G  E  N  K  T  L gacgccccgctcggccatattcctgtcttcgtgcgcggcggcagcatattgccactgcag
 D  A  P  L  G  H  I  P  V  F  V  R  G  G  S  I  L  P  L  Q gaaccgcggctcacgacgaaagaggcgcggcggacgccgtgggcgctgctggtagcgttg
 E  P  R  L  T  T  K  E  A  R  R  T  P  W  A  L  L  V  A  L ggcaaaggcagcacggcgaagggcgagctataccctcgatgatggagagagcctgaacccg
 G  K  G  S  T  A  K  G  E  L  Y  L  D  D  G  E  S  L  N  P aatgagacgctgagcgtggcgttcgtggcagagagggagagcttgagcgcgagtgcggta
 N  E  T  L  S  V  A  F  V  A  E  R  E  S  L  S  A  S  A  V gggttgttcagggatgggaatgcgttggcgaatgtgacggtgctgggcgttgcgagcgag
 G  L  F  R  D  G  N  A  L  A  N  V  T  V  L  G  V  A  S  E cccagtgctgtgaggattggtggcgtggatgttgggaaggggaggtgggcgtggagtagg
 P  S  A  V  R  I  G  G  V  D  V  G  K  G  R  W  A  W  S  R acgagtaaggtgttgagtgttacgcggttggatgaggtggtgaagggtggggcgtgggat
 T  S  K  V  L  S  V  T  R  L  D  E  V  V  K  G  G  A  W  D gtggattggacgcttacctggtag
 V  D  W  T  L  T  W  -
```

SEQ ID NO: 132
LENGTH: 1007
TYPE: PRT
ORGANISM: M. phaseolina
MAPSPLPGLRALARSVLTVVSIAQAQSSLSSSAGQDGVAASATTVTASATAYRPKFTVPADADVGQNLIPNIE

DPQAVDAQTVCPGYKASGVRRDAYGFAATLSLAGHACNVYGTDIETLNLTVQYQNADRLAINISPANIDASNS

SHYILPEQVIPRPVLDADADSSIRENDFQVAWSNDPSFSFTVIRRSTGDVVFSTEGSVLVYEDQFVEFVTSMP

AEYNIYGLGERIHGLRLGTNFTATIYAADVGDPIDDNIYGSHPFYLDTRYFEVDSATGNLTYVSNAPDAASNA

SFVSYSHGVFLRNAHGQEILLRPDNVTWRTLGGSIDLFFFDGPSQPEVTKQYQHGAVGLPAMQQYFTFGYHQC

RWGYANWSQFEEVVDNFIKFEIPLENIWLDIDYMLEYRDFTSDPNTFPVKEGLDVLQRLHDGGRHFIPIVDSA

IYIPNPENETDAYATYTRGNESGAFLKNPDGSEYIGAVWPGYTVFPDWLIDTAVPWWSDELVRWHKEVPFDGI

WIDMSEVSSFCVGSCGSGNLSLNPAHPPFSLPGEPGNVIYDYPEGFNITNATEAASASSASSSQAAATSSAAS

SSGTTSYLRTTPTPGVRNVNYPPYVIDNVQGDLAVHAVSPNATHENGVEEYDVHNLFGHQILNATYQGLLDVF

PGKRPFIIGRSTFAGSGKWAGHWGGDNYSKWAYMYFGIPQALSFSLFGIPMFGVDTCGFNGNSDEELCNRWMQ

LSAFFPFYRNHNTLSAKSQEPYVWSSVIDASKKAMAIRYALLPYLYTLFHAAHSTGATVMRALAWEFPDDPSL

ANVDTQFLLGPSLLVTPVLAPNASTVRGVFPGRGAEKWYDWYSQQVVDVLPGENKTLDAPLGHIPVFVRGGSI

LPLQEPRLTTKEARRTPWALLVALGKGSTAKGELYLDDGESLNPNETLSVAFVAERESLSASAVGLFRDGNAL

ANVTVLGVASEPSAVRIGGVDVGKGRWAWSRTSKVLSVTRLDEVVKGGAWDVDWTLTW*

SEQ ID NO: 133
LENGTH: 3033 (including 150 bp 5' UTR and 150 bp 3' UTR)
TYPE: DNA
ORGANISM: M. phaseolina
CTTGAGCACCGAAAAGCGATGGGGGCCAACACCAGCGACTCATACACATCGGCCGATATGGCCGACCCGATTT

TCAGCATTTATGAAGCCGCCTGCGGACGGTTCTGACGAGACTGCAATTCAGAGAACGTCGTGGACAGGCACTT

CACAATGGCTCCTCAGACGGAATACGTACCTCGCAACTGGACGAGGAGCAGTAAGGACGCGGCCGGCCATCCC

AGCCTGTTCTTGCAGAGTAACAACCCGCACATCCCATGTGCCTTCTCCTTCGAGGTGCTCCGTCCAAACCTCT

TCCGCACGACTTTCCAATCAGAAAGTCACCCCTTGCCACCGCACCCGCAGGCCGCCATCCCCGCACCAGATCT

GGGGTCTGAGAAGCCTGAAATCGATAGTTCAGAAACGTCCGCCAAGTTCACTCACAATGGAGTGACCGCAACG

GTGGATTGGGCAGACACTCCTATCGTCAGCCTTCAATTCGTCGACGCAAAGACACCTATCCACACGGATCTCC

CCTTCCGGTCCTACGCCATCGACGGCAGCGGCGTCGCGCACTACACGCGCTACAACCGGCACACGCTCCACGT

CGGGCTGGGCGAGAAGCCCGCACCCATGGACCTGTCGAACCGGCACTTCGTTCTCTCCGCTACGGACTGCTTC

GGTAAGACTGCCTCCCCATTATGCCCTCTTTTTCGTCTGACAGGGTGAAATCGCAGGCTACGATGTGTACCGC

ACGGACCCGATGTACAAACACATCCCACTGCTCATCAACGCGACGCCCACGGGCGTGGTCGGCGTTTTCTCGA

CCTCGCACTCGCGGGGGACGTACTCGGTCGGCTCCGAGATGGACGGGCTGTGGGGCCACTTCAAGGTGTACCG

GCAGGACCACGGCGGGCTGGAGGAGTATCTGATCACGGGGCGGACCATCAGCGACGTCGTGCGGACCTACGCC

TCGCTGGTAGGCAAGCCGCTGCGAGTGCCGCGCTGGGCCTTCGGTTATCTGGCTGGCGGCATGAAATGTGCGT

CCTCCCGATTCCCTCCCTATCTCTCTCTCTCATCACCAAGAAACGAGACTCATGACTGACGGGATTTGAAACA

CAGACTCCATGCTCGACGAGCCGCGCGCCGCTGATGCGCTGATGGCCTTCGCCGACCAGCTGCGTGCGCACGA

CATCCCCTGCTCCGGCTTCCAGATGTCGAGCGGCTACACGGTCGCCGAGACGGAGCCCAAGACGCGCAACGTC

TTCACCTGGAACCGGCACCGCTTCCCGGACCCCAAGGGCTGGATCGACGCCTACCACGCGCGCGGCATCAAGC

TCATCGCCAACATCAAGCCCTACGTGCTGGGCAGCCACCCCAAGTACGAGGAGCTGAGAGCCGGTGGCGCCTT

CTTCCAAGACCCCATAACCAAGGCGTCGGCGGAGGCGCGGTTGTGGAGTGCCGGCGGTGGCGAGAGCGGGGTG

GGCGGCCACATTGACTTCACGTCGAAGAAGGGGTATGAGTGGTGGTATGAGGGCGTGAAGGAGCTGCGGGAGC

TGGGCATTGATTGCATGTGGAATGACAAGTGAGTGAGAACTTTTCGTCTGTGAAAGAGGCAGAACGGCTAACA

TTTGCAGTAATGAGTACACCATTCCGCATGACGGATGGGCTTGCGCGCTCGATCACCCGAACGCCGTCACTAC

-continued

GGCGGCCAAGGAGAGGGCGAGCGGCAGGAAGGACATCGGGCTGTGGGGACGGGCGCTCCACACCGAACTGATG

GGCCGGTCCTCGCACGACGCGGTACTGGCGGTGCGGCCAGATGAGCGGCCCTTCATCCTGACGCGCAGCGCCA

CGGCGGGCAGCATGCGCTACTGCTCAAGTAGCTGGTCGGGCGACAATGTGACCAGTTGGGACGGTATGAAGGG

GTCCAACGCACTCAGCCTTGGCGCGGGCATGTGCCTTCTCCAGTGCTACGGGCACGATATCGGCGGCTTCGAG

GGCCCTCAGCCGACGCCGGAGCTGCTGCTGCGCTGGGTGCAGATGGGCATCTACTCATCGCGCTTCGCCATCA

ACTGCTTCAAAACTTCGCCGGACAACAACCGCGTCGGCGACGTCATTGAGCCTTGGATGTACCCGGAGATCAC

GCCCCTTGTCCGCGCCACCATCAAGCGCCGCTATGCCCTCCTGCCCTATATCTATTCCCTCCACCTCGAGAGT

CATCTGCACGCCACCCCGCCCCAGCGCTGGACCGGCTGGGGCTACGAGTCCGACCCAGAAGTGTGGACCCCGG

CACTCAAAGGTGGCGAGACCCAATTCTTCCTCGGTGACGCGCTGCTTGTCGGTGGGGTGTTCCAGCCTGGCGA

GGAGACGGCGAAGCTATACCTCCCCAAGAAGGAAGGCGACGAGGAAGCCGAGTTCTTAAACCTCAACGCTCCT

TATCAGTATTTGAAAGCGGGTCAGTGGGCGGTGATCGAGTCCAAGTGGCAGGACAGCGTGCCCGTTCTGGCAA

AGGTTGGCGCCGCCATCCCGGTAGGCAAGGACATCCAAGTGTTGTCGCCGGGCGAAAAGGAGAACCCCGCTAA

CCTCCCGCCGGACGACTATCGTGGCGTGGAGATCTTCCCAGCGAGAGCGGGAGGCAAGTGGTTTGAGACAACC

TGGCTCGAGGATGATGGCGTCACAATCTCCGGTACCATTTCTTCCTTCACTTTCCGGTACAGTGCTACCGAAA

AGGAGATTATTGTCGATTTTGCGCCTAAGATCGAAGGTTTCAAGCCCGTGTGGAACTGTCTAGACGTTATCTT

GCCGGTCGGTGAGAAGAGGTCGGTAGTGAGTGAAAGCGGAAAGCAATTGAAGAAAGTTGGGCAGGACAAGGTG

GGCCGCGCTATATTCGCTCTGGAATCCGTACTGTAGTATGTAAAGGACATACGGACCAATTCTCGACGAAACA

AAAAAATATAAAATCAAAGAGAGCTTTCCACTACGATCGGTCTCTCTTCAACAAGCTCTACAATTTGTGATTC

GACTTTTCCCTCAATGATTGAGCCACGGGATTGAAAAGTC

SEQ ID NO: 134
LENGTH: 2544
TYPE: DNA
ORGANISM: *M. phaseolina*
FEATURE NAME/KEY: CDS
LOCATION: (1)...(2544)

```
atggctcctcagacggaatacgtacctcgcaactggacgaggagcagtaaggacgcggcc
 M  A  P  Q  T  E  Y  V  P  R  N  W  T  R  S  S  K  D  A  A ggccatcccagcctgttcttgcagagtaacaacccgcacatcccatgtgccttctccttc
 G  H  P  S  L  F  L  Q  S  N  N  P  H  I  P  C  A  F  S  F gaggtgctccgtccaaacctcttccgcacgactttccaatcagaaagtcaccccttgcca
 E  V  L  R  P  N  L  F  R  T  T  F  Q  S  E  S  H  P  L  P ccgcacccgcaggccgccatccccgcaccagatctggggtctgagaagcctgaaatcgat
 P  H  P  Q  A  A  I  P  A  P  D  L  G  S  E  K  P  E  I  D agttcagaaacgtccgccaagttcactcacaatggagtgaccgcaacggtggattgggca
 S  S  E  T  S  A  K  F  T  H  N  G  V  T  A  T  V  D  W  A gacactcctatcgtcagccttcaattcgtcgacgcaaagacacctatccacacggatctc
 D  T  P  I  V  S  L  Q  F  V  D  A  K  T  P  I  H  T  D  L cccttccggtcctacgccatcgacggcagcggcgtcgcgcactacacgcgctacaaccgg
 P  F  R  S  Y  A  I  D  G  S  G  V  A  H  Y  T  R  Y  N  R cacacgctccacgtcgggctgggcgagaagcccgcacccatggacctgtcgaaccggcac
 H  T  L  H  V  G  L  G  E  K  P  A  P  M  D  L  S  N  R  H ttcgttctctccgctacggactgcttcggctacgatgtgtaccgcacggacccgatgtac
 F  V  L  S  A  T  D  C  F  G  Y  D  V  Y  R  T  D  P  M  Y aaacacatcccactgctcatcaacgcgacgcccacgggcgtggtcggcgttttctcgacc
 K  H  I  P  L  L  I  N  A  T  P  T  G  V  V  G  V  F  S  T tcgcactcgcgggggacgtactcggtcggctccgagatggacgggctgtggggccacttc
 S  H  S  R  G  T  Y  S  V  G  S  E  M  D  G  L  W  G  H  F aaggtgtaccggcaggaccacggcgggctggaggagtatctgatcacggggcggaccatc
 K  V  Y  R  Q  D  H  G  G  L  E  E  Y  L  I  T  G  R  T  I
```

```
agcgacgtcgtgcggacctacgcctcgctggtaggcaagccgctgcgagtgccgcgctgg
 S  D  V  V  R  T  Y  A  S  L  V  G  K  P  L  R  V  P  R  W gccttcggttatctggctggcggcatgaaatactccatgctcgacgagccgcgcgccgct
 A  F  G  Y  L  A  G  G  M  K  Y  S  M  L  D  E  P  R  A  A gatgcgctgatggccttcgccgaccagctgcgtgcgcacgacatccctgctccggcttc
 D  A  L  M  A  F  A  D  Q  L  R  A  H  D  I  P  C  S  G  F cagatgtcgagcggctacacggtcgccgagacggagcccaagacgcgcaacgtcttcacc
 Q  M  S  S  G  Y  T  V  A  E  T  E  P  K  T  R  N  V  F  T tggaaccggcaccgcttcccggaccccaagggctggatcgacgcctaccacgcgcgcggc
 W  N  R  H  R  F  P  D  P  K  G  W  I  D  A  Y  H  A  R  G atcaagctcatcgccaacatcaagccctacgtgctgggcagccaccccaagtacgaggag
 I  K  L  I  A  N  I  K  P  Y  V  L  G  S  H  P  K  Y  E  E ctgagaccggtggcgccttcttccaagaccccataaccaaggcgtcggcggaggcgcgg
 L  R  A  G  G  A  F  F  Q  D  P  I  T  K  A  S  A  E  A  R ttgtggagtgccggcggtggcgagagcggggtgggcggccacattgacttcacgtcgaag
 L  W  S  A  G  G  G  E  S  G  V  G  G  H  I  D  F  T  S  K aagggggtatgagtggtggtatgagggcgtgaaggagctgcgggagctgggcattgattgc
 K  G  Y  E  W  W  Y  E  G  V  K  E  L  R  E  L  G  I  D  C atgtggaatgacaataatgagtacaccattccgcatgacggatgggcttgcgcgctcgat
 M  W  N  D  N  N  E  Y  T  I  P  H  D  G  W  A  C  A  L  D cacccgaacgccgtcactacggcggccaaggagagggcgagcggcaggaaggacatcggg
 H  P  N  A  V  T  T  A  A  K  E  R  A  S  G  R  K  D  I  G ctgtggggacgggcgctccacaccgaactgatgggccggtcctcgcacgacgcggtactg
 L  W  G  R  A  L  H  T  E  L  M  G  R  S  S  H  D  A  V  L gcggtgcggccagatgagcggcccttcatcctgacgcgcagcgccacggcgggcagcatg
 A  V  R  P  D  E  R  P  F  I  L  T  R  S  A  T  A  G  S  M cgctactgctcaagtagctggtcgggcgacaatgtgaccagttgggacggtatgaagggg
 R  Y  C  S  S  W  S  G  D  N  V  T  S  W  D  G  M  K  G tccaacgcactcagccttggcgcgggcatgtgccttctccagtgctacgggcacgatatc
 S  N  A  L  S  L  G  A  G  M  C  L  L  Q  C  Y  G  H  D  I ggcggcttcgagggccctcagccgacgccggagctgctgctgcgctgggtgcagatgggc
 G  G  F  E  G  P  Q  P  T  P  E  L  L  L  R  W  V  Q  M  G atctactcatcgcgcttcgccatcaactgcttcaaaacttcgccggacaacaaccgcgtc
 I  Y  S  S  R  F  A  I  N  C  F  K  T  S  P  D  N  N  R  V ggcgacgtcattgagccttggatgtacccggagatcacgccccttgtccgcgccaccatc
 G  D  V  I  E  P  W  M  Y  P  E  I  T  P  L  V  R  A  T  I aagcgccgctatgccctcctgccctatatctattccctccacctcgagagtcatctgcac
 K  R  R  Y  A  L  L  P  Y  I  Y  S  L  H  L  E  S  H  L  H gccaccccgccccagcgctggaccggctgggctacgagtccgacccagaagtgtggacc
 A  T  P  P  Q  R  W  T  G  W  G  Y  E  S  D  P  E  V  W  T ccggcactcaaaggtggcgagacccaattcttcctcggtgacgcgctgcttgtcggtggg
 P  A  L  K  G  G  E  T  Q  F  F  L  G  D  A  L  L  V  G  G gtgttccagcctggcgaggagacggcgaagctataccctcccaagaaggaaggcgacgag
 V  F  Q  P  G  E  E  T  A  K  L  Y  L  P  K  K  E  G  D  E gaagccgagttcttaaacctcaacgctccttatcagtatttgaaagcgggtcagtgggcg
 E  A  E  F  L  N  L  N  A  P  Y  Q  Y  L  K  A  G  Q  W  A gtgatcgagtccaagtggcaggacagcgtgcccgttctggcaaaggttggcgccgccatc
 V  I  E  S  K  W  Q  D  S  V  P  V  L  A  K  V  G  A  A  I ccggtaggcaaggacatccaagtgttgtcgccgggcgaaaaggagaaccccgctaacctc
 P  V  G  K  D  I  Q  V  L  S  P  G  E  K  E  N  P  A  N  L ccgccggacgactatcgtggcgtggagatcttcccagcgagagcggggaggcaagtggttt
 P  P  D  D  Y  R  G  V  E  I  F  P  A  R  A  G  G  K  W  F gagacaacctggctcgaggatgatggcgtcacaatctccggtaccatttcttccttcact
 E  T  T  W  L  E  D  D  G  V  T  I  S  G  T  I  S  S  F  T
```

-continued

```
ttccggtacagtgctaccgaaaaggagattattgtcgattttgcgcctaagatcgaaggt
 F  R  Y  S  A  T  E  K  E  I  I  V  D  F  A  P  K  I  E  G ttcaagcccgtgtggaactgtctagacgttatcttgccggtcggtgagaagaggtcggta
 F  K  P  V  W  N  C  L  D  V  I  L  P  V  G  E  K  R  S  V gtgagtgaaagcggaaagcaattgaagaaagttgggcaggacaaggtgggccgcgctata
 V  S  E  S  G  K  Q  L  K  K  V  G  Q  D  K  V  G  R  A  I ttcgctctggaatccgtactgtag
 F  A  L  E  S  V  L  -
```

SEQ ID NO: 135
LENGTH: 847
TYPE: PRT
ORGANISM: *M. phaseolina*

```
MAPQTEYVPRNWTRSSKDAAGHPSLFLQSNNPHIPCAFSFEVLRPNLFRTTFQSESHPLPPHPQAAIPAPDLG

SEKPEIDSSETSAKFTHNGVTATVDWADTPIVSLQFVDAKTPIHTDLPFRSYAIDGSGVAHYTRYNRHTLHVG

LGEKPAPMDLSNRHFVLSATDCFGYDVYRTDPMYKHIPLLINATPTGVVGVFSTSHSRGTYSVGSEMDGLWGH

FKVYRQDHGGLEEYLITGRTISDVVRTYASLVGKPLRVPRWAFGYLAGGMKYSMLDEPRAADALMAFADQLRA

HDIPCSGFQMSSGYTVAETEPKTRNVFTWNRHRFPDPKGWIDAYHARGIKLIANIKPYVLGSHPKYEELRAGG

AFFQDPITKASAEARLWSAGGGESGVGGHIDFTSKKGYEWWYEGVKELRELGIDCMWNDNNEYTIPHDGWACA

LDHPNAVTTAAKERASGRKDIGLWGRALHTELMGRSSHDAVLAVRPDERPFILTRSATAGSMRYCSSSWSGDN

VTSWDGMKGSNALSLGAGMCLLQCYGHDIGGFEGPQPTPELLLRWVQMGIYSSRFAINCFKTSPDNNRVGDVI

EPWMYPEITPLVRATIKRRYALLPYIYSLHLESHLHATPPQRWTGWGYESDPEVWTPALKGGETQFFLGDALL

VGGVFQPGEETAKLYLPKKEGDEEAEFLNLNAPYQYLKAGQWAVIESKWQDSVPVLAKVGAAIPVGKDIQVLS

PGEKENPANLPPDDYRGVEIFPARAGGKWFETTWLEDDGVTISGTISSFTFRYSATEKEIIVDFAPKIEGFKP

VWNCLDVILPVGEKRSVVSESGKQLKKVGQDKVGRAIFALESVL*
```

SEQ ID NO: 136
LENGTH: 1717 (including 150 bp 5' UTR and 150 bp 3' UTR)
TYPE: DNA
ORGANISM: *M. phaseolina*

```
AACGCGGTGCTCGAGGCTGCGGGCGCGTTGACGGAGGTGACGGGCCGCCAGCCTGAGCTGCCGGACTGGGCGT

TCGATGGCGCCATCTTGGGGATTCAGGGTGGACAGGAGAAGGTGGAGCGCATCGTCAGGGACGCGCTGGCGGC

GGATATGCCGCTCGTGAGCGTGTGGCTGCAGGACTGGAGCGGTACCAGGCTGCAGGCCGGCGCGTATAATGTG

TCCATCAGCCGCCTTTGGTGGAACTGGGAGCCCGATGCTACGCTCTACCCAACCTGGGCGGAGTGGGTGCCAC

ATCTAAGAAGTGAGTACGGCGTCAGGACGATGAGCTATGTGAACACGTTCCTGGCAAATGTCAGCAGCAAGAC

GACAGGGTACAACCGGTCCTTCTACGCGGAGGCTGCCGCGGAAGGGCGCTTCGTGCTGAATGCCACGGCGGGA

GATGGCTCGCCCTGGACGGTGACGAGCGGACCCGGCATCGACGCTGGCCTGCTGGACCTCTCGAACGAGACGA

CCAGGCAGTGGTTCAAGGACCTGTACAAGGAGCAGTACTACTCCGTCCCCATCTCCGGCGGTAAGTTTGCCCT

ACCCTTGTTTCAATCGCTCAACCATTTACTCACTTCCAACCGTAGCCATGCAAGACTTCGGCGAATACCTTGA

CGTCACCTCCGTCGTCAGCATATCCAGCGGCACCATCAACCCGCGCCTCTTCCACAACGAATACCCGGCCGCC

TGGGCCAAGCTGCTCCGCGAAGTCGTCGAAGAACTCGGCCTCGCCAACGACACCATCGGCTTCCACCGCTCGG

CTTCGACCTTCTCGCTGCCGCACACCAACCTCTTCTGGGTTGGCGACCAGAACATCGACACCTCGCGCGAAGA

CGGCATGCGGGCCGCCATCAGCTCCGCGCTGCACGTCGGCCTCAGCGGCTTCGCGCAGTCGCACTCGGACATC

GGCGGCTACACCAACACGCTCGCGCCGGTGGGCAACATCACGCGCTCCGCGGCGCTGCTGGGGCGCTGGGGCG

AGATGGGCGCGTTTGGCGGTGCCGCCTTCAGGACGCACGAGGGGAACATCCCCCAGGTGAATGCACAGGCGTA

CACAAATGCCAGCACCCTGGCGTATCATTCGTACAATGCGCGTCTGTTCGCCGCGCTGAAGACGTACCGGAAA

AGCGTGGTGGGCGAGTATCAGAGGTCCGGGTGGCCGCTGTTGCGGCATCCGGTCGTGTATGCGCCGCGCGACG

AACGTGCCGTGGCGACCGTGGATGAGGTGTTCTGGCTCGGCGAGGCACTGCTCGTCGCGCCCGTATATGACGT

CGAGGCGCAGACGCTCGAGGTGTATCTACCGAGGATCGAGGTCGGGAGCGACGGGCAGGCTGTCGAGGGGGCG
```

-continued

```
CAGTACAAGCATTTGTGGACGGGCCAGCTGTTTGAACCCGGGGAGACGGTTACAGTCGATGCGCCGTGGGGTA

AGCCGGGTATTTTTGTCAGGTGGCCGTTGAAGGATGGTGAGGACGAGGCGTTGCAGGGATTGTGGGATTTCGT

GAAGAAGGAGAATGGGACGGCTTTGACTGCTTGAGCGGGATGGGGGAAAGAAAGCGGACTGAGCGCGTGGCTC

CTCCGAGTGGAAAGAAGCATTGTGGGAGAGGAATTAATCTGGTGCGCTCGATAAGACGGGCTCAAAAGCAATA

GAAAACATCTGACCTCGTCGGTTGCCACGCACACAGCA
```

SEQ ID NO: 137
LENGTH: 1359
TYPE: DNA
ORGANISM: M. phaseolina
FEATURE NAME/KEY: CDS
LOCATION: (1)...(1359)

```
atgccgctcgtgagcgtgtggctgcaggactggagcggtaccaggctgcaggccggcgcg
 M   P   L   V   S   V   W   L   Q   D   W   S   G   T   R   L   Q   A   G   A tataatgtgtccatcagccgcctttggtggaactgggagcccgatgctacgctctaccca
 Y   N   V   S   I   S   R   L   W   W   N   W   E   P   D   A   T   L   Y   P acctgggcggagtgggtgccacatctaagaagtgagtacggcgtcaggacgatgagctat
 T   W   A   E   W   V   P   H   L   R   S   E   Y   G   V   R   T   M   S   Y gtgaacacgttcctggcaaatgtcagcagcaagacgacagggtacaaccggtccttctac
 V   N   T   F   L   A   N   V   S   S   K   T   T   G   Y   N   R   S   F   Y gcggaggctgccgcggaagggcgcttcgtgctgaatgccacggcgggagatggctcgccc
 A   E   A   A   A   E   G   R   F   V   L   N   A   T   A   G   D   G   S   P tggacggtgacgagcggacccggcatcgacgctggcctgctggacctctcgaacgagacg
 W   T   V   T   S   G   P   G   I   D   A   G   L   L   D   L   S   N   E   T accaggcagtggttcaaggacctgtacaaggagcagtactactccgtccccatctccggc
 T   R   Q   W   F   K   D   L   Y   K   E   Q   Y   Y   S   V   P   I   S   G gccatgcaagacttcggcgaataccttgacgtcacctccgtcgtcagcatatccagcggc
 A   M   Q   D   F   G   E   Y   L   D   V   T   S   V   V   S   I   S   S   G accatcaacccgcgcctcttccacaacgaataccccggccgcctgggccaagctgctccgc
 T   I   N   P   R   L   F   H   N   E   Y   P   A   A   W   A   K   L   L   R gaagtcgtcgaagaactcggcctcgccaacgacaccatcggcttccaccgctcggcttcg
 E   V   V   E   E   L   G   L   A   N   D   T   I   G   F   H   R   S   A   S accttctcgctgccgcacaccaacctcttctgggttggcgaccagaacatcgacacctcg
 T   F   S   L   P   H   T   N   L   F   W   V   G   D   Q   N   I   D   T   S cgcgaagacggcatgcgggccgccatcagctccgcgctgcacgtcggcctcagcggcttc
 R   E   D   G   M   R   A   A   I   S   S   A   L   H   V   G   L   S   G   F gcgcagtcgcactcggacatcggcggctacaccaacacgctcgcgccggtgggcaacatc
 A   Q   S   H   S   D   I   G   G   Y   T   N   T   L   A   P   V   G   N   I acgcgctccgcggcgctgctggggcgctgggcgagatgggcgcgtttggcggtgccgcc
 T   R   S   A   A   L   L   G   R   W   G   E   M   G   A   F   G   G   A   A ttcaggacgcacgaggggaacatcccccaggtgaatgcacaggcgtacacaaatgccagc
 F   R   T   H   E   G   N   I   P   Q   V   N   A   Q   A   Y   T   N   A   S accctggcgtatcattcgtacaatgcgcgtctgttcgccgcgctgaagacgtaccggaaa
 T   L   A   Y   H   S   Y   N   A   R   L   F   A   A   L   K   T   Y   R   K agcgtggtgggcgagtatcagaggtccgggtggccgctgttgcggcatccggtcgtgtat
 S   V   V   G   E   Y   Q   R   S   G   W   P   L   L   R   H   P   V   V   Y gcgccgcgcgacgaacgtgccgtggcgaccgtggatgaggtgttctggctcggcgaggca
 A   P   R   D   E   R   A   V   A   T   V   D   E   V   F   W   L   G   E   A ctgctcgtcgcgcccgtatatgacgtcgaggcgcagacgctcgaggtgtatctaccgagg
 L   L   V   A   P   V   Y   D   V   E   A   Q   T   L   E   V   Y   L   P   R atcgaggtcggggagcgacgggcaggctgtcgagggggcgcagtacaagcatttgtggacg
 I   E   V   G   S   D   G   Q   A   V   E   G   A   Q   Y   K   H   L   W   T ggccagctgtttgaacccggggagacggttacagtcgatgcgccgtggggtaagccgggt
 G   Q   L   F   E   P   G   E   T   V   T   V   D   A   P   W   G   K   P   G
```

```
atttttgtcaggtggccgttgaaggatggtgaggacgaggcgttgcagggattgtgggat
 I  F  V  R  W  P  L  K  D  G  E  D  E  A  L  Q  G  L  W  D ttcgtgaagaaggagaatgggacggctttgactgcttga
 F  V  K  K  E  N  G  T  A  L  T  A  -
```

SEQ ID NO: 138
LENGTH: 452
TYPE: PRT
ORGANISM: *M. phaseolina*
MPLVSVWLQDWSGTRLQAGAYNVSISRLWWNWEPDATLYPTWAEWVPHLRSEYGVRTMSYVNTFLANVSSKTT

GYNRSFYAEAAAEGRFVLNATAGDGSPWTVTSGPGIDAGLLDLSNETTRQWFKDLYKEQYYSVPISGAMQDFG

EYLDVTSVVSISSGTINPRLFHNEYPAAWAKLLREVVEELGLANDTIGFHRSASTFSLPHTNLFWVGDQNIDT

SREDGMRAAISSALHVGLSGFAQSHSDIGGYTNTLAPVGNITRSAALLGRWGEMGAFGGAAFRTHEGNIPQVN

AQAYTNASTLAYHSYNARLFAALKTYRKSVVGEYQRSGWPLLRHPVVYAPRDERAVATVDEVFWLGEALLVAP

VYDVEAQTLEVYLPRIEVGSDGQAVEGAQYKHLWTGQLFEPGETVTVDAPWGKPGIFVRWPLKDGEDEALQGL

WDFVKKENGTALTA*

SEQ ID NO: 139
LENGTH: 2110 (including 150 bp 5' UTR and 150 bp 3' UTR)
TYPE: DNA
ORGANISM: *M. phaseolina*
CGCTTATCCACTAGTCTCCACGCCTCTTCCGTCCTTCCCGCTCGATATCAAGTTTTGGTCGTTTGTCAACACG

TATAACTGAGCGGTCCAAGCTCTGTAACATTTCCTCAATCTCTTAACTTCCGCGTTCAGGTGTATCATACCAA

AACCATGGACAAGTATATCAACAAAGCAAAGTCTAAATTCCAGGACAAAGTCCAGCCCTTCCTCCAGGACCGC

AACAACTCATCACACCAAAACAGCAACCACAATAGCCCCCCTCCAATACCTCCCAAGCCACTCATTCCGCTCA

AGTCTCAACAAGCGGACCGACCGTCGAGCATCACGCCAGTGACGGCCCTCGACGTCCTCCGCTACCGCTACCA

ACACGGCGCCAACCTCGGCTCTATCTACGTGCTCGAAAAATGGCTCTTCCCGGGTATGTTCCCCAGCAACTGC

TCGGGCCACGGCAAGAGCAGCGAGCTCGAGGCCGTGCGAGCCAATGTCGCGGAGTTGGGCATGGACGGCGCGC

GTGAGAAGTTCGAGCGGCACTGGGCGGGCGCCGTCACGGACGCAGACCTTGACTGGCTGGTCGGGAAGGCCAA

ATGTACGTAATCCATGCATTAACACTTTTCTCCATCCCTCATCTCCTAGCAGTACTACTGCTGACAGAGATGC

CCAAGGCAACACCATCCGCCTCCCCATCGGTTACTTCACACTGGGCCCCGCCGCCCACGCCGACCCTTCCGAC

CCCTTCCACGCTTTCGCCCCCGTCTACGCGAACGCGTGGTCGTCGGTGTGCGCGTTGGTGTCGCGCCTGCACG

CTCGCGGCATCGGTACCCTTCTTGACCTGCACGGCCTGCCCGGCGGCGCCAACGGCTGCGATCACTCGGGCAC

GAACAGTGGGCGCGCCGAGCACTGGCGGTCGCCGGCGTGCCGCGACCGGAGCACGCGCTGCTTGGCGTGGATC

GCGGAGCAGGTGCGCGAGGATGCAGGGCTCAGGGAAGGTGTTGTGGGGTTGCAGGTATGCAATGAAGCGGAGT

GGGGCGCGAAGGGGCTGTGGGAGTGGTATGAGGGTGTGGTTGGGGCAGTTGCGGCGGCGGAGCCCGGGTTGCC

GGTGTATGTGAGTGATGCATGGGATTTGGGGAGGGCGGTGGAGTGGGCGAGGGGGGTTAATAAGGTTGGTGTT

GGGGCGAGAGTGAGCCCGGTGGTGGTGGATACGCATTTGTACTGGTGTTTTGCGGATGCGGATAAGAAGAAGG

GGCCCGATGATATTGTGAGGGAGGTGAGGGGCAAGCTGGGGCAGTTGGACGGCAAAGAGGGAGATGTGTTGAA

GAATGGAGCGGTGGCGGTCATAATCGGGGAGTATAGTTGCGTGTTGAGTGAAGAGACGTGGAAGAAGGGTGGG

GATAAGAGCAAGGATGATTGGGTGAGGGAATTCGGGCAGGCTCTGAGCAGCAGGTTCCAACAGAGGGCTCTGG

GCAGTCATTTTTGGACATACAAGATGCAGTGGATGCCGGGTGGAGAATGGGGATTCAAGGCATGCACTGAGAA

GGGTGCCATCACGCCGCATTGGACGCTGACGCTATCTGCGGACGATGTGCGTCAGAGGCTCCAGTCCGCATTG

GCGCAAAGGGATGAGAGATTTGGAAGGACTTTCGGGCAGCATTGCGGGTTCTGGGATCAAAATTCTCCCGGGA

CGCCCTTCGAGCACTGGAGATATGAACAAGGATGGAAGCAAGGCTTCGATGACGCAGCAGCCTTTTTTGGTAT

GCGGGTGAATGGAGGCTTCGGAGATGTCAATGCCTTGGGCGAAGGTGGTCAAGGTGGAGGTGTTGGGGGCGAT

AAGATTGGGAATCTGGAAATCTGGGTGAGGAGAAGGCTGATTGAGAGCGGCATGGGGGGGCCGTTCGTCTGGG

AGTACGAGCAGGGATTGAGGAAAGGTGTGGGTGAGTTCTGTGAGCTTGCGGGAGGGCTTTAATAATGCACGAA

-continued

CGCCCGCAATCCCAACCAATCAGTGCCTTTTCAGGCTAGTTTAGCTGGGCTTGCTGGTTCGGATTATGAACGT

ATCTAGTCTACCATTTTTTGCCTCTTGTTGACATATATTCACTGAATAAGATACAGGAGAAGGTAG

```
SEQ ID NO: 140
LENGTH: 1734
TYPE: DNA
ORGANISM: M. phaseolina
FEATURE NAME/KEY: CDS
LOCATION: (1)...(1734)
atggacaagtatatcaacaaagcaaagtctaaattccaggacaaagtccagcccttcctc
 M  D  K  Y  I  N  K  A  K  S  K  F  Q  D  K  V  Q  P  F  L caggaccgcaacaactcatcacaccaaaacagcaaccacaatagccccctccaatacct
 Q  D  R  N  N  S  S  H  Q  N  S  N  H  N  S  P  P  P  I  P cccaagccactcattccgctcaagtctcaacaagcggaccgaccgtcgagcatcacgcca
 P  K  P  L  I  P  L  K  S  Q  Q  A  D  R  P  S  S  I  T  P gtgacggccctcgacgtcctccgctaccgctaccaacacggcgccaacctcggctctatc
 V  T  A  L  D  V  L  R  Y  R  Y  Q  H  G  A  N  L  G  S  I tacgtgctcgaaaaatggctcttcccgggtatgttccccagcaactgctcgggccacggc
 Y  V  L  E  K  W  L  F  P  G  M  F  P  S  N  C  S  G  H  G aagagcagcgagctcgaggccgtgcgagccaatgtcgcggagttgggcatggacggcgcg
 K  S  S  E  L  E  A  V  R  A  N  V  A  E  L  G  M  D  G  A cgtgagaagttcgagcggcactgggcgggcgccgtcacggacgcagaccttgactggctg
 R  E  K  F  E  R  H  W  A  G  A  V  T  D  A  D  L  D  W  L gtcgggaaggccaaatgcaacaccatccgcctccccatcggttacttcacactgggcccc
 V  G  K  A  K  C  N  T  I  R  L  P  I  G  Y  F  T  L  G  P gccgcccacgccgaccccttccgacccttccacgctttcgccccccgtctacgcgaacgcg
 A  A  H  A  D  P  S  D  P  F  H  A  F  A  P  V  Y  A  N  A tggtcgtcggtgtgcgcgttggtgtcgcgcctgcacgctcgcggcatcggtacccttctt
 W  S  S  V  C  A  L  V  S  R  L  H  A  R  G  I  G  T  L  L gacctgcacggcctgccggcggcgccaacggctgcgatcactcgggcacgaacagtggg
 D  L  H  G  L  P  G  G  A  N  G  C  D  H  S  G  T  N  S  G cgcgccgagcactggcggtcgccggcgtgccgcgaccggagcacgcgctgcttggcgtgg
 R  A  E  H  W  R  S  P  A  C  R  D  R  S  T  R  C  L  A  W atcgcggagcaggtgcgcgaggatgcagggctcagggaaggtgttgtggggttgcaggta
 I  A  E  Q  V  R  E  D  A  G  L  R  E  G  V  V  G  L  Q  V tgcaatgaagcggagtggggcgcgaaggggctgtgggagtggtatgagggtgtggttggg
 C  N  E  A  E  W  G  A  K  G  L  W  E  W  Y  E  G  V  V  G gcagttgcggcggcggagcccgggttgccggtgtatgtgagtgatgcatgggatttgggg
 A  V  A  A  A  E  P  G  L  P  V  Y  V  S  D  A  W  D  L  G agggcggtggagtgggcgagggggggttaataaggttggtgttggggcgagagtgagcccg
 R  A  V  E  W  A  R  G  V  N  K  V  G  V  G  A  R  V  S  P gtggtggtggatacgcatttgtactggtgttttgcggatgcggataagaagaaggggccc
 V  V  V  D  T  H  L  Y  W  C  F  A  D  A  D  K  K  K  G  P gatgatattgtgagggaggtgaggggcaagctggggcagttggacggcaaagagggagat
 D  D  I  V  R  E  V  R  G  K  L  G  Q  L  D  G  K  E  G  D gtgttgaagaatggagcggtggcggtcataatcggggagtatagttgcgtgttgagtgaa
 V  L  K  N  G  A  V  A  V  I  I  G  E  Y  S  C  V  L  S  E gagacgtggaagaagggtggggataagagcaaggatgattgggtgagggaattcgggcag
 E  T  W  K  K  G  G  D  K  S  K  D  D  W  V  R  E  F  G  Q gctctgagcagcaggttccaacagagggctctgggcagtcattttttggacatacaagatg
 A  L  S  S  R  F  Q  Q  R  A  L  G  S  H  F  W  T  Y  K  M cagtggatgccgggtggagaatggggattcaaggcatgcactgagaaggtgccatcacg
 Q  W  M  P  G  G  E  W  G  F  K  A  C  T  E  K  G  A  I  T ccgcattggacgctgacgctatctgcggacgatgtgcgtcagaggctccagtccgcattg
 P  H  W  T  L  T  L  S  A  D  D  V  R  Q  R  L  Q  S  A  L gcgcaaagggatgagagatttggaaggactttcgggcagcattgcgggttctgggatcaa
 A  Q  R  D  E  R  F  G  R  T  F  G  Q  H  C  G  F  W  D  Q
```

-continued

```
aattctcccgggacgcccttcgagcactggagatatgaacaaggatggaagcaaggcttc
 N  S  P  G  T  P  F  E  H  W  R  Y  E  Q  G  W  K  Q  G  F gatgacgcagcagccttttttggtatgcgggtgaatggaggcttcggagatgtcaatgcc
 D  D  A  A  A  F  F  G  M  R  V  N  G  G  F  G  D  V  N  A ttgggcgaaggtggtcaaggtggaggtgttgggggcgataagattgggaatctggaaatc
 L  G  E  G  G  Q  G  G  G  V  G  G  D  K  I  G  N  L  E  I tgggtgaggagaaggctgattgagagcggcatggggggccgttcgtctgggagtacgag
 W  V  R  R  R  L  I  E  S  G  M  G  G  P  F  V  W  E  Y  E cagggattgaggaaaggtgtgggtgagttctgtgagcttgcgggagggctttaa
 Q  G  L  R  K  G  V  G  E  F  C  E  L  A  G  G  L  -
```

SEQ ID NO: 141
LENGTH: 577
TYPE: PRT
ORGANISM: *M. phaseolina*
MDKYINKAKSKFQDKVQPFLQDRNNSSHQNSNHNSPPPIPPKPLIPLKSQQADRPSSITPVTALDVLRYRYQH

GANLGSIYVLEKWLFPGMFPSNCSGHGKSSELEAVRANVAELGMDGAREKFERHWAGAVTDADLDWLVGKAKC

NTIRLPIGYFTLGPAAHADPSDPFHAFAPVYANAWSSVCALVSRLHARGIGTLLDLHGLPGGANGCDHSGTNS

GRAEHWRSPACRDRSTRCLAWIAEQVREDAGLREGVVGLQVCNEAEWGAKGLWEWYEGVVGAVAAAEPGLPVY

VSDAWDLGRAVEWARGVNKVGVGARVSPVVVDTHLYWCFADADKKKGPDDIVREVRGKLGQLDGKEGDVLKNG

AVAVIIGEYSCVLSEETWKKGGDKSKDDWVREFGQALSSRFQQRALGSHFWTYKMQWMPGGEWGFKACTEKGA

ITPHWTLTLSADDVRQRLQSALAQRDERFGRTFGQHCGFWDQNSPGTPFEHWRYEQGWKQGFDDAAAFFGMRV

NGGFGDVNALGEGGQGGGVGGDKIGNLEIWVRRRLIESGMGGPFVWEYEQGLRKGVGEFCELAGGL*

SEQ ID NO: 142
LENGTH: 1641 (including 150 bp 5' UTR and 150 bp 3' UTR)
TYPE: DNA
ORGANISM: *M. phaseolina*
TCCATAATCACACTATATAACTTGCGACAATCTCTGGCATATCTTGCCTATAGCTCAACTCGGCTCCACATTC

CAGCCCCACGACTGAGCTTGCTGGTGTGCATTAACGTCACATCCCTCCTTTGAGGCATGGTACACTCCACTCC

CATCATGCAATACCTCGCAGCTCTTGTTGCCGCTCTTGCGGCCACAACGACTGCCGCTCCCGTCCTGGACTCG

AGGTCTTTCGGGACGGATCTTACGGCACTGCTCAAGAAGATCGGGATCTCTATTCAAACCAACAGCAACTCCC

ACGGTTCTCTTTCAGGCGCTATTACGTTCACTTTTCCGAAGGTCAGCCTCTCTCTGAAGCGGTTCGTCCATGA

AATCACCTGGCCAAAAGGATGTACCGAGCAGGCCTTCATGGATTGGTCCACGTTCAAGGCCAACGGTGTCAAC

CTTGGCGCATGGTTAGAGCAAGAAAGGACACATGATCCTGCGTGGTGGGACTCGCACGCCCTGGCACTATTG

ATGAGTGGAACTTCTGCGCCCAACTTGGCAACCGGTGCGGTACCGTCCTCGAAGAACGTTATGCCACCTTCAT

CACCCACTTCAGATATCGACAAGCTCGCTTCAGTAGGCGTCAATGTGCTTCGAATTCCCACAACCTATGCCGCC

TGGGTGAGGGTACCTGGCTCAAACCTCTACACTGGCAATCAGCAGAAACATCTCTCCAAAATCGTAAACTACG

CCATCGAAAAGTACAACATGCATATTATCATCGGGTTGCATAGTCTCCCTGGTGGTGTCAACTCTCTGGACAT

TGGCGAAGGAGTCGGTCGCTACGGCTGGTTCAACAATGCGACAAATCTGGACTATTCCTTCCAAGCTGTCGAC

GCAATCCTCGCATTTATCAAGGGCTCGGGCCACATCAACGCCTTCACTGTCGCACCCCTGAATGAAGCTTCCG

ATACGAATCTCGTCGGGTTTGGGAGCGCAGCAGGCTTGACCGCCAACGGAACAGACTGGATCAACACCTACGT

CAAGGGCGTGCTTCTAAAGATTGCTAAATTGGACAAACGTATTCCTTTGATGCTTCAGGACTGCTTCGAGGGA

CCGGATTACTGGGCCCCCTTTTACGATGCAAGTACCAATCTCGTTATTGATAGCCACGTCTACTATTTTGCTG

CCAGCGGTGTTTACAGCCAATATGTGGCCCCGGCCATCTGCGGTCAAGCTGCCGCTCTCCCCGGCAAGGGCAA

GTTTCCGGTTTTTGTTGGTGAATGGGCACTGCAGACGGCCTACAACAACACATTCGACAGTCGCAAGACCATC

TTCGACACTCAACGTTATGCTTGGCAGAAGTATGCATCTGGCGGCGCCTTCTGGACGGCCAGGTCGCTCTCAA

CCACTGCTGTTGATGGAGAGGGTATCCAGGAAGATTACTGGAGTTACATCGGCCTTCAAGAGGCTGGCGTGAT

CACATCGCAGACGAACAGCAGCTATTGTTGATCAGTCAGCGGGAGAATATCTTGATGAGGATGAATCATCTTT

-continued

TTCTCTTGCATAACTGGAGGCTCTCCGTTCCTTGTATATAATATGATAGCGTTGTAATGTCTGATGTGTATTT

TCTTCATGTAGAAGGATAAATAGACAAGTGCGGAA

```
SEQ ID NO: 143
LENGTH: 1341
TYPE: DNA
ORGANISM: M. phaseolina
FEATURE NAME/KEY: CDS
LOCATION: (1)...(1341)
atgcaatacctcgcagctcttgttgccgctcttgcggccacaacgactgccgctcccgtc
 M  Q  Y  L  A  A  L  V  A  A  L  A  A  T  T  T  A  A  P  V ctggactcgaggtctttcgggacggatcttacggcactgctcaagaagatcgggatctct
 L  D  S  R  S  F  G  T  D  L  T  A  L  L  K  K  I  G  I  S attcaaaccaacagcaactcccacggttctctttcaggcgctattacgttcacttttccg
 I  Q  T  N  S  N  S  H  G  S  L  S  G  A  I  T  F  T  F  P aaggtcagcctctctctgaagcggttcgtccatgaaatcacctggccaaaaggatgtacc
 K  V  S  L  S  L  K  R  F  V  H  E  I  T  W  P  K  G  C  T gagcaggccttcatggattggtccacgttcaaggccaacggtgtcaaccttggcgcatgg
 E  Q  A  F  M  D  W  S  T  F  K  A  N  G  V  N  L  G  A  W ttagagcaagaaaggacacatgatcctgcgtggtgggactcgcacgcccctggcactatt
 L  E  Q  E  R  T  H  D  P  A  W  W  D  S  H  A  P  G  T  I gatgagtggaacttctgcgcccaacttggcaaccggtgcggtaccgtcctcgaagaacgt
 D  E  W  N  F  C  A  Q  L  G  N  R  C  G  T  V  L  E  E  R tatgccaccttcatcaccacttcagatatcgacaagctcgcttcagtaggcgtcaatgtg
 Y  A  T  F  I  T  T  S  D  I  D  K  L  A  S  V  G  V  N  V cttcgaattcccacaacctatgccgcctgggtgagggtacctggctcaaacctctacact
 L  R  I  P  T  T  Y  A  A  W  V  R  V  P  G  S  N  L  Y  T ggcaatcagcagaaacatctctccaaaatcgtaaactacgccatcgaaaagtacaacatg
 G  N  Q  Q  K  H  L  S  K  I  V  N  Y  A  I  E  K  Y  N  M catattatcatcgggttgcatagtctccctggtggtgtcaactctctggacattggcgaa
 H  I  I  I  G  L  H  S  L  P  G  G  V  N  S  L  D  I  G  E ggagtcggtcgctacggctggttcaacaatgcgacaaatctggactattccttccaagct
 G  V  G  R  Y  G  W  F  N  N  A  T  N  L  D  Y  S  F  Q  A gtcgacgcaatcctcgcatttatcaagggctcgggccacatcaacgccttcactgtcgca
 V  D  A  I  L  A  F  I  K  G  S  G  H  I  N  A  F  T  V  A cccctgaatgaagcttccgatacgaatctcgtcgggtttgggagcgcagcaggcttgacc
 P  L  N  E  A  S  D  T  N  L  V  G  F  G  S  A  A  G  L  T gccaacggaacagactggatcaacacctacgtcaagggcgtgcttctaaagattgctaaa
 A  N  G  T  D  W  I  N  T  Y  V  K  G  V  L  L  K  I  A  K ttggacaaacgtattcctttgatgcttcaggactgcttcgagggaccggattactgggcc
 L  D  K  R  I  P  L  M  L  Q  D  C  F  E  G  P  D  Y  W  A cccttttacgatgcaagtaccaatctcgttattgatagccacgtctactattttgctgcc
 P  F  Y  D  A  S  T  N  L  V  I  D  S  H  V  Y  Y  F  A  A agcggtgtttacagccaatatgtggccccggccatctgcggtcaagctgccgctctcccc
 S  G  V  Y  S  Q  Y  V  A  P  A  I  C  G  Q  A  A  A  L  P ggcaagggcaagtttccggttttgttggtgaatgggcactgcagacggcctacaacaac
 G  K  G  K  F  P  V  F  V  G  E  W  A  L  Q  T  A  Y  N  N acattcgacagtcgcaagaccatcttcgacactcaacgttatgcttggcagaagtatgca
 T  F  D  S  R  K  T  I  F  D  T  Q  R  Y  A  W  Q  K  Y  A tctggcggcgccttctggacggccaggtcgctctcaaccactgctgttgatggagagggt
 S  G  G  A  F  W  T  A  R  S  L  S  T  T  A  V  D  G  E  G atccaggaagattactggagttacatcggccttcaagaggctggcgtgatcacatcgcag
 I  Q  E  D  Y  W  S  Y  I  G  L  Q  E  A  G  V  I  T  S  Q acgaacagcagctattgttga
 T  N  S  S  Y  C  -
```

SEQ ID NO: 144
LENGTH: 446
TYPE: PRT
ORGANISM: M. phaseolina
MQYLAALVAALAATTTAAPVLDSRSFGTDLTALLKKIGISIQTNSNSHGSLSGAITFTFPKVSLSLKRFVHEI

TWPKGCTEQAFMDWSTFKANGVNLGAWLEQERTHDPAWWDSHAPGTIDEWNFCAQLGNRCGTVLEERYATFIT

TSDIDKLASVGVNVLRIPTTYAAWVRVPGSNLYTGNQQKHLSKIVNYAIEKYNMHIIIGLHSLPGGVNSLDIG

EGVGRYGWENNATNLDYSFQAVDAILAFIKGSGHINAFTVAPLNEASDTNLVGFGSAAGLTANGTDWINTYVK

GVLLKIAKLDKRIPLMLQDCFEGPDYWAPFYDASTNLVIDSHVYYFAASGVYSQYVAPAICGQAAALPGKGKF

PVFVGEWALQTAYNNTFDSRKTIFDTQRYAWQKYASGGAFWTARSLSTTAVDGEGIQEDYWSYIGLQEAGVIT

SQTNSSYC*

SEQ ID NO: 145
LENGTH: 1657 (including 150 bp 5' UTR and 150 bp 3' UTR)
TYPE: DNA
ORGANISM: M. phaseolina
GTGGGAAGTGCCAAGCTGGGAAGTCACAAGCTACCGCTGGCACCTACTTATACTTGTCCAAACCCACCTCCTT

TACTTCACTCTTTCTTCTGCTCTGCCTTCTACACTATCACCTGAAACCCTTCCTTGCTACTGCAGACACCACG

GACGATGACGCTCACACTCCTTTTGCTGGTGCTCTTTTTTGCGCTGGCCGTCGCCCAAATCGCAACGTCCGAT

GACCTCTTCGAGGCTAAGCTTGCAGAGTCTCCTCTTCTGCGTGGAGTCAACCTTGGCGGATGGCTCGTTCTTG

AACCCTTCCTCACGCCGGAGCTGTTCACGAATGGCGCCATCGACCAGTGGACTTTCGATCAGAAGCCCGGATC

CGAAAATCTGCTCCGAAGCCACTGGGACACATACTGCACCGAGGCCGACATCAAGAAGCTCGCATCATACGGT

ATCAGTGCGTAAGTCATCGCCCAGCAGGATAGGAAATGGGATCTCTGCACTTATTTGCTTCAAGGGTTCGCAT

CGGTATTGGTTTCTGGGCCTACGACAATGCAGGCACCCCATACCACTCTGGCGCCGATGCTTACCTCAGCCAG

GCCATCAAATGGGCAAAGGATGCCGGTCTGCTAGTAGCCATCGAGCTTCATGGAGCACCTGGATCTCAGAATG

GAAATGCCTGCTCAGGTCACGAAGGAAAGGGGgAGGTATGTGTGGAAAGGTCCCTTCAAGAGCAGCAGGCGCT

TATTATTTTCAGTGGCAAAGCGACGCCGTCAATCTCAACCGTACGACGAGCGTACTCGAGACCATAGCGCAAA

AATACGGTACGAAGGAACTCGCCAGCACAGTCATATCCATTGAGCTGGTGAATGAGCCCACAAACACACCACC

AAaCACCCTCGAAGTTACAAAGGCTTGGACGAAGGCTACCTACGAGGTTGTGCGTGCGGCTGCAAGCAACAAG

GACTTGCGCATCGTCATGCATGACCAGTGGGTCACTCCGAAGAATTGGCTCGACATCAATGAGGCATTGAACG

GTCCGAACCCCGACTCCTTCGTTCTGGATGTCCATCATTATCAGATATTCACCCAAGGAGATCGGCACCTCGA

CCAGCCTGGCCACATCCAGAAAGTCTGCCAGTTCGCCAGCGAGCAGCTCGCGCTGGCCAAGCAAACCCAACTG

CCGATCCAGGTCGGTGAGTTCAGCGGCAACACGTTCATCTGCGTCAACCCGGACGGCAGCACCTTCGCAGATC

CTGCTGGCACTGGCAAGGTCTGCAAGGTCGAGGGTTGCCAATGCGAGACGGATGGAGGGATTGCGGTGGACAA

ATGGGGGGATGCGATCACTCAACAGGTCCGGCGGTATGTGGAGGCGCAACTGTATGTGTTTGAGCAGTACGCT

GGAGGATGGTTCTTCTGGAATTTCAAGGGGCCGGGCTCCTGGGGGTTCATGACCGGCGTGGAGAAGGGGTTCA

TTCCTCAACCACTCTCTGATAGGCGCTACCCCAATCCGTGTCTGTAGCCCTATCGTAACAGCCGCGTCAGCAA

GCACATTTATCTCCGTTGAGGGCTCTCTCGCTATGGCATTTGATAGAGTTGCTGCGAAACATATCCTCTAGT

CAATGCATTCTGAGGAGCATCAGCGGTAACGGACAAGAACATAGCAATGTC

SEQ ID NO: 146
LENGTH: 1251
TYPE: DNA
ORGANISM: M. phaseolina
FEATURE NAME/KEY: CDS
LOCATION: (1)...(1251)
atgacgctcacactccttttgctggtgctcttttttgcgctggccgtcgcccaaatcgca
 M  T  L  T  L  L  L  V  L  F  F  A  L  A  V  A  Q  I  A acgtccgatgacctcttcgaggctaagcttgcagagtctcctcttctgcgtggagtcaac
 T  S  D  D  L  F  E  A  K  L  A  E  S  P  L  L  R  G  V  N

```
cttggcggatggctcgttcttgaaccttcctcacgccgagctgttcacgaatggcgcc
 L  G  G  W  L  V  L  E  P  F  L  T  P  E  L  F  T  N  G  A atcgaccagtggactttcgatcagaagcccggatccgaaaatctgctccgaagccactgg
 I  D  Q  W  T  F  D  Q  K  P  G  S  E  N  L  L  R  S  H  W gacacatactgcaccgaggccgacatcaagaagctcgcatcatacggtatcagtgcggtt
 D  T  Y  C  T  E  A  D  I  K  K  L  A  S  Y  G  I  S  A  V cgcatcggtattggtttctgggcctacgacaatgcaggcaccccataccactctggcgcc
 R  I  G  I  G  F  W  A  Y  D  N  A  G  T  P  Y  H  S  G  A gatgcttacctcagccaggccatcaaatgggcaaaggatgccggtctgctagtagccatc
 D  A  Y  L  S  Q  A  I  K  W  A  K  D  A  G  L  L  V  A  I gagcttcatggagcacctggatctcagaatggaaatgcctgctcaggtcacgaaggaaag
 E  L  H  G  A  P  G  S  Q  N  G  N  A  C  S  G  H  E  G  K ggggagtggcaaagcgacgccgtcaatctcaaccgtacgacgagcgtactcgagaccata
 G  E  W  Q  S  D  A  V  N  L  N  R  T  T  S  V  L  E  T  I gcgcaaaaatacggtacgaaggaactcgccagcacagtcatatccattgagctggtgaat
 A  Q  K  Y  G  T  K  E  L  A  S  T  V  I  S  I  E  L  V  N gagcccacaaacacaccaccaaacacccctcgaagttacaaaggcttggacgaaggctacc
 E  P  T  N  T  P  P  N  T  L  E  V  T  K  A  W  T  K  A  T tacgaggttgtgcgtgcggctgcaagcaacaaggacttgcgcatcgtcatgcatgaccag
 Y  E  V  V  R  A  A  A  S  N  K  D  L  R  I  V  M  H  D  Q tgggtcactccgaagaattggctcgacatcaatgaggcattgaacggtccgaaccccgac
 W  V  T  P  K  N  W  L  D  I  N  E  A  L  N  G  P  N  P  D tccttcgttctggatgtccatcattatcagatattcacccaaggagatcggcacctcgac
 S  F  V  L  D  V  H  H  Y  Q  I  F  T  Q  G  D  R  H  L  D cagcctggccacatccagaaagtctgccagttcgccagcgagcagctcgcgctggccaag
 Q  P  G  H  I  Q  K  V  C  Q  F  A  S  E  Q  L  A  L  A  K caaacccaactgccgatccaggtcggtgagttcagcggcaacacgttcatctgcgtcaac
 Q  T  Q  L  P  I  Q  V  G  E  F  S  G  N  T  F  I  C  V  N ccggacggcagcaccttcgcagatcctgctggcactggcaaggtctgcaaggtcgagggt
 P  D  G  S  T  F  A  D  P  A  G  T  G  K  V  C  K  V  E  G tgccaatgcgagacggatggagggattgcggtggacaaatgggggatgcgatcactcaa
 C  Q  C  E  T  D  G  G  I  A  V  D  K  W  G  D  A  I  T  Q caggtccggcggtatgtggaggcgcaactgtatgtgtttgagcagtacgctggaggatgg
 Q  V  R  R  Y  V  E  A  Q  L  Y  V  F  E  Q  Y  A  G  G  W ttcttctggaatttcaaggggccgggctcctgggggttcatgaccggcgtggagaagggg
 F  F  W  N  F  K  G  P  G  S  W  G  F  M  T  G  V  E  K  G ttcattcctcaaccactctctgataggcgctaccccaatccgtgtctgtag
 F  I  P  Q  P  L  S  D  R  R  Y  P  N  P  C  L  -

SEQ ID NO: 147
LENGTH: 416
TYPE: PRT
ORGANISM: M. phaseolina
MTLTLLLLVLFFALAVAQIATSDDLFEAKLAESPLLRGVNLGGWLVLEPFLTPELFTNGAIDQWTFDQKPGSE

NLLRSHWDTYCTEADIKKLASYGISAVRIGIGFWAYDNAGTPYHSGADAYLSQAIKWAKDAGLLVAIELHGAP

GSQNGNACSGHEGKGEWQSDAVNLNRTTSVLETIAQKYGTKELASTVISIELVNEPTNTPPNTLEVTKAWTKA

TYEVVRAAASNKDLRIVMHDQWVTPKNWLDINEALNGPNPDSFVLDVHHYQIFTQGDRHLDQPGHIQKVCQFA

SEQLALAKQTQLPIQVGEFSGNTFICVNPDGSTFADPAGTGKVCKVEGCQCETDGGIAVDKWGDAITQQVRRY

VEAQLYVFEQYAGGWFFWNFKGPGSWGFMTGVEKGFIPQPLSDRRYPNPCL*

SEQ ID NO: 148
LENGTH: 1185 (including 150 bp 5' UTR and 150 bp 3' UTR)
TYPE: DNA
ORGANISM: M. phaseolina
TTTATTAATTCTTAAGGCCGCACAACTCCCTCCCGCTTTTTCTTCCCCATCCTCCAACGGTCCTCACTCTCTC

TACACGGTCCATTCTTACCGTAGTCCTTCGTTATTGTACCAATCCAAAACAACCGTTAATATCTTAATTCCTC
```

-continued

```
CACCATGAAGTTCACCTCCGCCGCCGTCCTCCTTGCTGGCTCCGCCCCCATGGCCAGCGCCCTCCGCAAGGGC

TTTAACATTGGAGCCACTAACGCCGACGGCTCCTGCAAGACCCAGGCGCAATGGGCCCAGGACTTCAAGGGCA

TGAAGAACCTGCCCGGCAACTTCAAGGACGTCCGTGTCTACGCCGCCAGCGACTGCAACACCCTCGACCTGGC

TGTCCCCGCCGCCAAGGATGCTGGCATTCAGCTCCTTGTTGGCATTTGGACCGAGGATGACGCCCACTACAGC

GCGGAGAAGGCTGCTCTCGAGGCCGCCATCACCAAGTACGGTGTCGACTGGATCTCGGCCGTCTCCGTCGGCA

GCGAGGATCTCTACCGCGGCGACACCACCTCGTGGCGCCTGGCCGAGCAGGTCTATGACGTGCGCGGCATGAT

CTCTCAGGACAAGTACGGCGGCAAGGGCATTTGGGTCGGCCACGTCGATACGTACAACGCCTTCAACGCCTCG

TCGGCCGACCTCATCCAGGCGGTCGACTTCCTCGGCGTCGACGCGTACCCGTACTGGCAGGGCGTGACGCCCG

ACCAGGCCCAGGCCACCTTCCAGAAGGCCATTGATGAGACGCAGAACTTCATCAACCAGTACAACCCGGCCGC

TAAGCTGTGGATCACTGAGACCGGCTGGCCCACCGCCGGCCCCAACTTCGGCAATAGCGTCGCGAACAAGGAG

AACGCTAAGACCTTCTGGGATGCCGTCCTGTGCAAGTACGCCTCCCAGTACTCCATCTGGTGGTACACCCTCC

ACGACACCTCCACCGAGGCTCAGGACTTCGGCGTCGTCGACGACAACTTCGGCGCTCTCTTCGACCTCAACTG

CCCCAGCTCTTAAACGAGCTGTTTCGGGAAGGCGGAACGAGATGGGAAAATGTGGGAAATGCATGGCGCTATG

TCTCCTGGGTATTCAAGCAACGTCTTAGAGAAGAGAAGAGGAATAGAGATGTGGATGAGATGAATTAGAAGAG

AATCTAAACAGTCAGTG
```

SEQ ID NO: 149
LENGTH: 885
TYPE: DNA
ORGANISM: M. phaseolina
FEATURE NAME/KEY: CDS
LOCATION: (1)...(885)

```
atgaagttcacctccgccgccgtcctccttgctggctccgccccatggccagcgccctc
 M   K   F   T   S   A   A   V   L   L   A   G   S   A   P   M   A   S   A   L cgcaagggctttaacattggagccactaacgccgacggctcctgcaagacccaggcgcaa
 R   K   G   F   N   I   G   A   T   N   A   D   G   S   C   K   T   Q   A   Q tgggcccaggacttcaagggcatgaagaacctgcccggcaacttcaaggacgtccgtgtc
 W   A   Q   D   F   K   G   M   K   N   L   P   G   N   F   K   D   V   R   V tacgccgccagcgactgcaacaccctcgacctggctgtccccgccgccaaggatgctggc
 Y   A   A   S   D   C   N   T   L   D   L   A   V   P   A   A   K   D   A   G attcagctccttgttggcatttggaccgaggatgacgcccactacagcgcggagaaggct
 I   Q   L   L   V   G   I   W   T   E   D   D   A   H   Y   S   A   E   K   A gctctcgaggccgccatcaccaagtacggtgtcgactggatctcggccgtctccgtcggc
 A   L   E   A   A   I   T   K   Y   G   V   D   W   I   S   A   V   S   V   G agcgaggatctctaccgcggcgacaccacctcgtggcgcctggccgagcaggtctatgac
 S   E   D   L   Y   R   G   D   T   T   S   W   R   L   A   E   Q   V   Y   D gtgcgcggcatgatctctcaggacaagtacggcggcaagggcatttgggtcggccacgtc
 V   R   G   M   I   S   Q   D   K   Y   G   G   K   G   I   W   V   G   H   V gatacgtacaacgccttcaacgcctcgtcggccgacctcatccaggcggtcgacttcctc
 D   T   Y   N   A   F   N   A   S   S   A   D   L   I   Q   A   V   D   F   L ggcgtcgacgcgtacccgtactggcagggcgtgacgcccgaccaggcccaggccaccttc
 G   V   D   A   Y   P   Y   W   Q   G   V   T   P   D   Q   A   Q   A   T   F cagaaggccattgatgagacgcagaacttcatcaaccagtacaacccggccgctaagctg
 Q   K   A   I   D   E   T   Q   N   F   I   N   Q   Y   N   P   A   A   K   L tggatcactgagaccggctggcccaccgccggccccaacttcggcaatagcgtcgcgaac
 W   I   T   E   T   G   W   P   T   A   G   P   N   F   G   N   S   V   A   N aaggagaacgctaagaccttctgggatgccgtcctgtgcaagtacgcctcccagtactcc
 K   E   N   A   K   T   F   W   D   A   V   L   C   K   Y   A   S   Q   Y   S atctggtggtacacccTccacgacacctccaccgaggctcaggacttcggcgtcgtcgac
 I   W   W   Y   T   L   H   D   T   S   T   E   A   Q   D   F   G   V   V   D gacaacttcggcgctctcttcgacctcaactgccccagctcttaaa
 D   N   F   G   A   L   F   D   L   N   C   P   S   S   -
```

SEQ ID NO: 150
LENGTH: 294
TYPE: PRT
ORGANISM: M. phaseolina
MKFTSAAVLLAGSAPMASALRKGFNIGATNADGSCKTQAQWAQDFKGMKNLPGNFKDVRVYAASDCNTLDLAV

PAAKDAGIQLLVGIWTEDDAHYSAEKAALEAAITKYGVDWISAVSVGSEDLYRGDTTSWRLAEQVYDVRGMIS

QDKYGGKGIWVGHVDTYNAFNASSADLIQAVDFLGVDAYPYWQGVTPDQAQATFQKAIDETQNFINQYNPAAK

LWITETGWPTAGPNFGNSVANKENAKTFWDAVLCKYASQYSIWWYTLHDTSTEAQDFGVVDDNFGALFDLNCP

SS*

SEQ ID NO: 151
LENGTH: 1373 (including 150 bp 5' UTR and 150 bp 3' UTR)
TYPE: DNA
ORGANISM: M. phaseolina
CACGTCGCTCTTTCTGGCCGAAGCTTCGCACTCCGAGTGCGCGCCATTCCTTTCGAGACTGCCACTTATTAGC

TGCACCGTCCCCGCTGCCCGTCGTTCCCGCGTCTTCCTCACCTCCAAAGATACCTGGTCGCCGCAACCACTC

CAACATGCGCCTTTCCACCCTCCTTCCCGCCGCCGCTCTGGCCATCGCCCCGCCGCCGCCTCGGGCACTCTG

GGCTTCTCGCTGGGTACCAAGCTCGCCGACGGCAGCTGCAAGTACCAGGCCGACTACGAGAAGGACTTCGACG

CCATTTCCAAGGCCACCGGCAGCAAGCTGGTCCGCGGCTACTCGGCCTCGGACTGCAACTGCGCCAAGGAGAT

CCTGCCCGCCGCGAAGGCCAAGGGCTTCCAGGTCGTCCTCGCCGTGTGGTGCGTGCGCCCCGTCTCTCGGTT

TAAGCATGCCGTATAAGGTTGTTTCCAGGTGGAGCCCATGACGCTGACGCGCAAGCACTTTCGTCCCGCAACA

GGCCCGATGTCGACGAGTCTCTCGAGGCCGACAAGAAGGCCCTCAAGACCTACGCTACCGACGAGTACGCCGA

CCAGATCTACGCCGTGACCGTCGGCTCCGAGACGCTCTACCGCGGCAATTTCACCGGCGAGGAGCTGCTCGAC

AAGATCAACGACGTGCGCACCGTCCTGCCCAAGGGCTGCAAGGTCGGCACCGCCGACTCGTGGAACAAGTGGG

CCGACGGCACTGGTGACGCGGTCGTCAAGGGCGGCGTCGACCTCATCCTCGCCAACGCCTTCGCCTACTGGCA

GGGCCAGGACATCAAGAACGCCTCTGCCACCTACTTCGAGGATATGGCTCGCGCCATTGAGCACATCCAGGAC

GTTGCTGGCGGCCCCGAGAAGGCTCCCGAAATCTGGAACGGCGAGACTGGCTGGCCCACCGATGGTACGTAGT

ATGCATCTCCGTTTCGAAATGCATGTGTGTTAACTCCAAACCAGGCGGCTCTGACTACGAGGACGCCAAGGCC

GGCACGGACATTGCTAAGACCTACTACCACGAGGCCGTCTGCGGTGCGCTCAAGTGGGGCGTCAACGCTTTCT

ACTTTGAGGCCTTCGACGAGCCTTGGAAGCCTCACGCCATCGGTGACTCTGGTGCCGCCGGTGACGAGACCAA

GTGGGGAGCCATGACCGCTGATCGCCAGGTCAAGTTCGACCTCAAGTGCAAATAGACGAGCTGTGTTCGTGTG

GATGAGATTCCACTAATTCACTTAGTCTTTTTTTGTGTCTTGCATTGGGCTGCGAGGTTTTACTTCTGCTAGG

CGAACTATTATTACCTGATATCCTATGGCTGTTTGGGGAAAGGAATTGATGGAGAGATT

SEQ ID NO: 152
LENGTH: 921
TYPE: DNA
ORGANISM: M. phaseolina
FEATURE NAME/KEY: CDS
LOCATION: (1)...(921)
atgcgcctttccaccctccttcccgccgccgctctggccatcgccccgccgccgcctcg
 M   R   L   S   T   L   L   P   A   A   A   L   A   I   A   P   A   A   A   S ggcactctgggcttctcgctgggtaccaagctcgccgacggcagctgcaagtaccaggcc
 G   T   L   G   F   S   L   G   T   K   L   A   D   G   S   C   K   Y   Q   A gactacgagaaggacttcgacgccatttccaaggccaccggcagcaagctggtccgcggc
 D   Y   E   K   D   F   D   A   I   S   K   A   T   G   S   K   L   V   R   G tactcggcctcggactgcaactgcgccaaggagatcctgcccgccgcgaaggccaagggc
 Y   S   A   S   D   C   N   C   A   K   E   I   L   P   A   A   K   A   K   G ttccaggtcgtcctcgccgtgtggcccgatgtcgacgagtctctcgaggccgacaagaag
 F   Q   V   V   L   A   V   W   P   D   V   D   E   S   L   E   A   D   K   K gccctcaagacctacgctaccgacgagtacgccgaccagatctacgccgtgaccgtcggc
 A   L   K   T   Y   A   T   D   E   Y   A   D   Q   I   Y   A   V   T   V   G

```
tccgagacgctctaccgcggcaatttcaccggcgaggagctgctcgacaagatcaacgac
 S  E  T  L  Y  R  G  N  F  T  G  E  E  L  L  D  K  I  N  D gtgcgcaccgtcctgcccaagggctgcaaggtcggcaccgccgactcgtggaacaagtgg
 V  R  T  V  L  P  K  G  C  K  V  G  T  A  D  S  W  N  K  W gccgacggcactggtgacgcggtcgtcaagggcggcgtcgacctcatcctcgccaacgcc
 A  D  G  T  G  D  A  V  V  K  G  G  V  D  L  I  L  A  N  A ttcgcctactggcagggccaggacatcaagaacgcctctgccacctacttcgaggatatg
 F  A  Y  W  Q  G  Q  D  I  K  N  A  S  A  T  Y  F  E  D  M gctcgcgccattgagcacatccaggacgttgctggcggccccgagaaggctcccgaaatc
 A  R  A  I  E  H  I  Q  D  V  A  G  G  P  E  K  A  P  E  I tggaacggcgagactggctggcccaccgatggcggctctgactacgaggacgccaaggcc
 W  N  G  E  T  G  W  P  T  D  G  G  S  D  Y  E  D  A  K  A ggcacggacattgctaagacctactaccacgaggccgtctgcggtgcgctcaagtgggc
 G  T  D  I  A  K  T  Y  Y  H  E  A  V  C  G  A  L  K  W  G gtcaacgctttctactttgaggccttcgacgagccttggaagcctcacgccatcggtgac
 V  N  A  F  Y  F  E  A  F  D  E  P  W  K  P  H  A  I  G  D tctggtgccgccggtgacgagaccaagtggggagccatgaccgctgatcgccaggtcaag
 S  G  A  A  G  D  E  T  K  W  G  A  M  T  A  D  R  Q  V  K ttcgacctcaagtgcaaatag
 F  D  L  K  C  K  -

SEQ ID NO: 153
LENGTH: 306
TYPE: PRT
ORGANISM: M. phaseolina
MRLSTLLPAAALAIAPAAASGTLGFSLGTKLADGSCKYQADYEKDFDAISKATGSKLVRGYSASDCNCAKEIL

PAAKAKGFQVVLAVWPDVDESLEADKKALKTYATDEYADQIYAVTVGSETLYRGNFTGEELLDKINDVRTVLP

KGCKVGTADSWNKWADGTGDAVVKGGVDLILANAFAYWQGQDIKNASATYFEDMARAIEHIQDVAGGPEKAPE

IWNGETGWPTDGGSDYEDAKAGTDIAKTYYHEAVCGALKWGVNAFYFEAFDEPWKPHAIGDSGAAGDETKWGA

MTADRQVKFDLKCK*

SEQ ID NO: 154
LENGTH: 1758 (including 150 bp 5' UTR and 150 bp 3' UTR)
TYPE: DNA
ORGANISM: M. phaseolina
AGAATTCAGGCTTAAATCCGCCTGCCGGCTTTTTCTTGTTTACAATTCCTCCAACTGCAGTCTCCCTCCCGTT

CTTGCCCCCAGCGCATTCTGAGGCATTGAGCGTCCGTAGGTCGTATCTCCTTCGCGCGCTCGCATTCCTGGTT

CGTCATGTTGTCACGATACTTCGCTTCCGCGTTGCTGGCTACGACCGTCGTTTTTGGCGCAGCTATGTATGCT

CCCTCTGCCCTCGAGCCGCCGCAGTCAGCACATTGACTTTTTACCTCAGCGAGAAGAGAAAGGTCTCCTTCAA

TTGGGGCGGGgAAAAGGTCTGCGGCCTCAACATTGGGGGATGGCTCGTCCTGGAACCGTAAGTTCGCCCAACA

AAACCAATCTCGTGACACAATCTCTTCGGCCTCCTTCAGATTCAACCTTCAGCAAACTGAGCTCGGAAATTAA

TTtGTTTTGGCTTCAGATGGATCACTCCCTCCATCTTCGAGCAGTTTGACGCGTCTCAGGGCATCATTGACGA

GTTCACACTGAACGAGAAGCTTGGCAGAGACAAGGCTTTGGAGGTTCTGAAACCGCATTGGGACAGCTGGGTC

GGGTTCGAGGATTTCCAGCGCATTGCCGACGCCGGCTTTAATCTCGTCAGGATCCCAGTCGGCTTCTGGGCCT

ATGACACGTTCGGCTCGGCCTACTCTCAGGGAGCTGCGCCGTACATCGATGCCGCCATTGACTGGGCCAGGGG

CACAGGCCTGAAGGTCCTGATTGATCTTCACGGCGCGCCGGGATCTCAGAACGGATACGACAATTCCGGGCAG

AGGATGGAAACCCCGCAATGGCTGCAGGGTGACACCGTCAACCAGACGCTCTCCGTCATCCAGCAGATTGCGG

ACAAGTACGCAAAAACCGAATACCAGGACGTCATCGCCGGCATCCAGCTGTTAAACGAACCGGCCGGTTACGA

GTTGGACGTCAACGCGATCAAGCAGTTCGACCGTGACGGATATGCGAAGGTCAGGAGTGTCAGTGACACCACG

GTCGTCATCCATGATGCTTTCCAGAACCCGAGCTCGTACAATGGCTGGATGACACCATCGGACAACAATGTTC

AGAATGTCGTTCTTGACCATCACGAGTACCAAGTTTTCGACAATGGCATGATCAAGTGGTCCGCCGCTGAACA

CCGGCAGGGTGTGTGCAACAATAGAGCTCGTTGGGAGGGCTCCGACAAGTGGACTATCGTGGGCGAATGGACT
```

-continued

```
GGTGCTATGACTGATTGCGCGAAATGGCTAAACGGTATGCCCACCCTCCTTTGACAACCTTTCCCAGTGTAAG

CTAACACATACTCCAGGCTACGGACGTGGTGCTCGTTATGATAACACCTTCGAGGGCGCCGGCTACGTCGGTG

ACTGTGGCTTCGCCAGCGACCTTGACTCCTGGGATCAGCAGCGCAAGGACGACACGCGCTGGTACATCGAGAC

GCAGCTGTCTGCATTCGAGAAGATCGATGGTTGGATCTTCTGGAACTTCAAGACCGAGCAGGCGCCCGAGTGG

GATTGGGGCAAGCTCTCCGCCGCAGGTGTCTTCCCAAACCCGGTCACGGACAGGAAGTTCTCCGCAGTCTGCT

AATTGTGGAGGATATCATGAGGGGTTCTGTCTGGGCTGGTTGGTGAAGCAATCCATTGTTCGAGAGGGCATGG

ACTGGGAATGGAACGACACACATCCAAGGTGCAACTTGTGATTTTCTAATAGGTTGGGCTTAGCAAGTTTCCC

ACACCG
```

SEQ ID NO: 155
LENGTH: 1242
TYPE: DNA
ORGANISM: M. phaseolina
FEATURE NAME/KEY: CDS
LOCATION: (1)...(1242)

```
atgttgtcacgatacttcgcttccgcgttgctggctacgaccgtcgttttggcgcagct
 M   L   S   R   Y   F   A   S   A   L   L   A   T   T   V   V   F   G   A   A atcgagaagagaaaggtctccttcaattggggcggggaaaaggtctgcggcctcaacatt
 I   E   K   R   K   V   S   F   N   W   G   G   E   K   V   C   G   L   N   I ggggatggctcgtcctggaaccatggatcactccctccatcttcgagcagtttgacgcg
 G   G   W   L   V   L   E   P   W   I   T   P   S   I   F   E   Q   F   D   A tctcagggcatcattgacgagttcacactgaacgagaagcttggcagagacaaggctttg
 S   Q   G   I   I   D   E   F   T   L   N   E   K   L   G   R   D   K   A   L gaggttctgaaaccgcattgggacagctgggtcgggttcgaggatttccagcgcattgcc
 E   V   L   K   P   H   W   D   S   W   V   G   F   E   D   F   Q   R   I   A gacgccggctttaatctcgtcaggatcccagtcggcttctgggcctatgacacgttcggc
 D   A   G   F   N   L   V   R   I   P   V   G   F   W   A   Y   D   T   F   G tcggcctactctcagggagctgcgccgtacatcgatgccgccattgactgggccaggggc
 S   A   Y   S   Q   G   A   A   P   Y   I   D   A   A   I   D   W   A   R   G acaggcctgaaggtcctgattgatcttcacggcgcgccgggatctcagaacggatacgac
 T   G   L   K   V   L   I   D   L   H   G   A   P   G   S   Q   N   G   Y   D aattccgggcagaggatggaaaccccgcaatggctgcagggtgacaccgtcaaccagacg
 N   S   G   Q   R   M   E   T   P   Q   W   L   Q   G   D   T   V   N   Q   T ctctccgtcatccagcagattgcggacaagtacgcaaaaaccgaataccaggacgtcatc
 L   S   V   I   Q   Q   I   A   D   K   Y   A   K   T   E   Y   Q   D   V   I gccggcatccagctgttaaacgaaccggccggttacgagttggacgtcaacgcgatcaag
 A   G   I   Q   L   L   N   E   P   A   G   Y   E   L   D   V   N   A   I   K cagttcgaccgtgacggatatgcgaaggtcaggagtgtcagtgacaccacggtcgtcatc
 Q   F   D   R   D   G   Y   A   K   V   R   S   V   S   D   T   T   V   V   I catgatgctttccagaacccgagctcgtacaatggctggatgacaccatcggacaacaat
 H   D   A   F   Q   N   P   S   S   Y   N   G   W   M   T   P   S   D   N   N gttcagaatgtcgttcttgaccatcacgagtaccaagttttcgacaatggcatgatcaag
 V   Q   N   V   V   L   D   H   H   E   Y   Q   V   F   D   N   G   M   I   K tggtccgccgctgaacaccggcagggtgtgtgcaacaatagagctcgttgggagggctcc
 W   S   A   A   E   H   R   Q   G   V   C   N   N   R   A   R   W   E   G   S gacaagtggactatcgtgggcgaatggactggtgctatgactgattgcgcgaaatggcta
 D   K   W   T   I   V   G   E   W   T   G   A   M   T   D   C   A   K   W   L aacggctacggacgtggtgctcgttatgataacaccttcgagggcgccggctacgtcggt
 N   G   Y   G   R   G   A   R   Y   D   N   T   F   E   G   A   G   Y   V   G gactgtggcttcgccagcgaccttgactcctgggatcagcagcgcaaggacgacacgcgc
 D   C   G   F   A   S   D   L   D   S   W   D   Q   Q   R   K   D   D   T   R tggtacatcgagacgcagctgtctgcattcgagaagatcgatggttggatcttctggaac
 W   Y   I   E   T   Q   L   S   A   F   E   K   I   D   G   W   I   F   W   N
```

```
ttcaagaccgagcaggcgcccgagtgggattggggcaagctctccgccgcaggtgtcttc
 F  K  T  E  Q  A  P  E  W  D  W  G  K  L  S  A  A  G  V  F ccaaacccggtcacggacaggaagttctccgcagtctgctaa
 P  N  P  V  T  D  R  K  F  S  A  V  C  -
```

SEQ ID NO: 156
LENGTH: 413
TYPE: PRT
ORGANISM: *M. phaseolina*
MLSRYFASALLATTVVFGAAIEKRKVSFNWGGEKVCGLNIGGWLVLEPWITPSIFEQFDASQGIIDEFTLNEK

LGRDKALEVLKPHWDSWVGFEDFQRIADAGFNLVRIPVGFWAYDTFGSAYSQGAAPYIDAAIDWARGTGLKVL

IDLHGAPGSQNGYDNSGQRMETPQWLQGDTVNQTLSVIQQIADKYAKTEYQDVIAGIQLLNEPAGYELDVNAI

KQFDRDGYAKVRSVSDTTVVIHDAFQNPSSYNGWMTPSDNNVQNVVLDHHEYQVFDNGMIKWSAAEHRQGVCN

NRARWEGSDKWTIVGEWTGAMTDCAKWLNGYGRGARYDNTFEGAGYVGDCGFASDLDSWDQQRKDDTRWYIET

QLSAFEKIDGWIFWNFKTEQAPEWDWGKLSAAGVFPNPVTDRKFSAVC*

SEQ ID NO: 157
LENGTH: 3057 (including 150 bp 5' UTR and 150 bp 3' UTR)
TYPE: DNA
ORGANISM: *M. phaseolina*
TATTTCTTCATTCATTCCCTTTTGCGCGTCCTTTTCTCCGCATTCCACGCATCATCACCAATCTCGCACGACC

GTCTCAGCCACGCGGAAAAAAAAAAGCCTGCCCACATTCCTGAACGGCAACACTACTCTCGCGACTCAGTCG

AGCCATGCCCCGCGACCACGACTCGCCCCGGCGCGACCGCGACCGCAACTACTCCCGTGACCGCCATCCCGCC

AGCGGCGGCGAAGGCTACCGCTCCGACCGCGAACGCCGCCGCCGCCGTCGCGAGAGCCGCGACCCAGCCGACG

ACACCCCTCCCCGCCGCGAGCAGCGTGCCCCCCGCCGCCACACGCGCGACCCGGCCAGCGACCGCGAGTACGA

CACGGACGCGGCGCGGCAGCAGCAGCAGCAGCAAGAGCGGCGCCGCCGCCGCGGGCACCGCGCCACCGACTCG

ACGGGCGAGCCCATCCTGCGGCAGCCGGAGCGCTCGTACGACTCGCCGTACCACAGCGGGTCGCCCAGCCCGA

GGAAAAAGCACGCCGCGGCGCATCGTGGGCGGAGGGAGAGAGGGAGCTATGGAGGCGGCGGCGACAGTTCGCG

GTGGACGGGCACGGACACGCCGGCGAGTAGAGACTCTGGGTCGAGCGGGCGGCCGCTGCTGCATGCAGATGCG

CTGGCGCAGTTGGATGTAATGAACTCGAAGAGCGGGTGGAAGGCGAACGCGTACGACGAGGCGTATCTGAAGC

GCGTGAGGGAGCAGGAGGCGGCAATGGAGAAGGAGCGGCAGAGGGAGCAGAGGAGGGAGAGGAGGCGGGAGAA

GGAAGCGAGGGCGATGGAGAGGGAAAAGAGGAGGAGGCATGAGGAGGAGATGGGATTTAGGCGGAGTCGGAAT

GTGGATGTAGAGTTGGAGGATGATGAGGATGAGGGGGAGGCGCAGCGCCTGAAGCCTGCGTATCCTCCTGTTG

CTGATGACGGGATTAGGGTGAGGGGCTATGATGACGAGTATCCGGAGCCCTACACGGATGACCCGTATACAGA

TGACCCTGCGGAGCCGATACGGAGACGGAGGGAATACACGGAGGAGGAGAGGGAGGAGAGGCGGCGGAGAAGA

AAGGAGAGAGCGCTTGCGGCAACTGCGGTTGCAGGAAGGAACAAGAAAAGCCGCGTCGTGAGTGGACCTCTAC

TGGAAGAGGGCGGCAAGGAGGATTACGAGTACCGTCTCGCACAGCGCCGCGGCGGTGGCGGTGGTAGCAGCGA

TGTTTATTACGACGAAGAGCTGAAGAAGAAAAAGCGAAAGAAGATCTTCATCATCGTCGGAATCATCGTGCTC

ATTCTCGCCATTGTAATCCCTGTCGCTGTTGTAGTATCAGGGAAAAACAAGGGCAGCGATGGGGATACTGCTG

CCGCCACTTCGTCGGACTCGAGTAAACCGGACAACAGCAATTTGAGCGGCATATCCGAAGACGATATCCCGGA

GTATGCACGAGGCGGCCTCCTGGACCCCTTCACTTGGTACGATACAGAAGACTTCAACGTCACCTTCACCAAC

GACACGGTCGGCGGTCTCTCGATTATGGGCCTCAATTCGACATGGGATGACAGTGTCCAGGCCAACGAACATG

TCCCGGCTCTGAACAAAGAGTTCAAGTACGGTGAAATGCCTATCCGGGGTGTTAATGTGGGCGGCTGGCTCAA

CATTGAACCGTGGATTACGCCCTCTTTCTTTGAGTCCTACAATACCCGCGACGGTGTCATCGACGAATGGACG

CTTACGACTAGTATGGGGGGAAAGGCCAAAGCAAATCTAGAAGAACACTACTCGTCATGGATCACTAAGCAGA

CCTGGGTGGACATTCGAAACGCGGGCTTCGACCACGTCCGTATTCCGTTTAACTACTGGGCTGTCACCACGTA

TGACGGAGACCCATACGTTGCCAAGGTCTCCTGGCGGTACCTTCTACGCGGCATTGAGTATGCCAGGCAGAAT

GGCCTCCGAATCAAGTTAGATTTGCACGGCTTGCCTGGTAGTCAAAATGGCTGGAACCACAGCGGAAGACAAG

```
GCGCCATCGGATGGTTAAACGGCACGGACGGTACGCTAAACGCGCAGCGCAGCATTGAAATCCATGATCAGCT

GTCACAGTTCTTCGCTCAGCCACGCTATAAGAACGTTGTTACGTTGTACGGCCTGGTGAATGAACCCCGCATG

GTGGAGCTCAACACGAACGACGTCCTTTCTTGGTACGACGAGGTCATTCCGAAGATTCGCCAGAACAACATCA

CGGCCATTCTTGTCTTTGGCGATGGTTTCCTTGGCCTGGACAACTGGCAGGGTAAGCTGCAGAATTACAAAGA

CCTCCTGCTTGACGTGCACCAGTACGTCATCTTCAACGTCGATCTGATCAAATTCTCGCACGCGGAGAAGGTC

AACTTTGCCTGCAAAGGCTGGACTCAACAGTCGCTGCGGTCCATGAACACGGAGACCGGCTTCGGTCCAACTA

TGTGCGGAGAGTGGTCTCAAGCCGACACGGATTGTACCCAGTACCTCAACAATGTCGGCTGGGGTACCCGTTG

GGAGGGCACCTACAATACAGGCAACAGTAGCACTTCCGTCCTCGAGCCCACTTGTCCCACAGACAACAACCCC

GTCTGCTCCTGCGAAAACGCCAACGCCGATCCGTCAAACTACAGCGACACGTACAAGAAGTTTTTGCTGCACT

TCGCGCTCGCCCAGATGTACAGCTTCGAGCAAGGCTGGGGTTGGTTCTACTGGACGTGGAAGACGGAGAAGGC

GGTTCAGTGGAGTTGGGAGAGCGGGATGAAGGCGGGCATTCTGCCCGAGAAGGCGTGGGATCGCAGTGCATTT

CAATGCAATACGACTGATATCCCGGACTATTCTGGAGAAGGATTGCCGGAGAACTACTGAGAGGTCAACCTCC

TCATCTTATGTGTAACGTCCTTTGAGCCTTTGCATTCCGGTTTTCGATTTTTTTTTTCTTGGTTAGATGTAT

CTGGTGCTTGTTGTTTGATGGCATCAAAGCGCATGAGCGACAGGATTTCATTGCATGATAGACT
```

SEQ ID NO: 158
LENGTH: 2757
TYPE: DNA
ORGANISM: *M. phaseolina*
FEATURE NAME/KEY: CDS
LOCATION: (1)...(2757)

```
atgccccgcgaccacgactcgccccggcgcgaccgcgaccgcaactactcccgtgaccgc
 M  P  R  D  H  D  S  P  R  R  D  R  D  R  N  Y  S  R  D  R catcccgccagcggcggcgaaggctaccgctccgaccgcgaacgccgccgccgccgtcgc
 H  P  A  S  G  G  E  G  Y  R  S  D  R  E  R  R  R  R  R  R gagagccgcgacccagccgacgacacccctccccgccgcgagcagcgtgcccccgccgc
 E  S  R  D  P  A  D  D  T  P  P  R  R  E  Q  R  A  P  R  R cacacgcgcgacccggccagcgaccgcgagtacgacacggacgcggcgcggcagcagcag
 H  T  R  D  P  A  S  D  R  E  Y  D  T  D  A  A  R  Q  Q  Q cagcagcaagagcggcgccgccgcgcgggcaccgcgccaccgactcgacgggcgagccc
 Q  Q  Q  E  R  R  R  R  R  G  H  R  A  T  D  S  T  G  E  P atcctgcggcagccggagcgctcgtacgactcgccgtaccacagcgggtcgcccagcccg
 I  L  R  Q  P  E  R  S  Y  D  S  P  Y  H  S  G  S  P  S  P aggaaaaagcacgccgcggcgcatcgtgggcggagggagagagggagctatggaggcggc
 R  K  K  H  A  A  A  H  R  G  R  R  E  R  G  S  Y  G  G  G ggcgacagttcgcggtggacgggcacggacacgccggcgagtagagactctgggtcgagc
 G  D  S  S  R  W  T  G  T  D  T  P  A  S  R  D  S  G  S  S gggcggccgctgctgcatgcagatgcgctggcgcagttggatgtaatgaactcgaagagc
 G  R  P  L  L  H  A  D  A  L  A  Q  L  D  V  M  N  S  K  S gggtggaaggcgaacgcgtacgacgaggcgtatctgaagcgcgtgagggagcaggaggcg
 G  W  K  A  N  A  Y  D  E  A  Y  L  K  R  V  R  E  Q  E  A gcaatggagaaggagcggcagagggagcagaggagggagaggaggcgggagaaggaagcg
 A  M  E  K  E  R  Q  R  E  Q  R  R  E  R  R  R  E  K  E  A agggcgatggagagggaaaagaggaggaggcatgaggaggagatgggatttaggcggagt
 R  A  M  E  R  E  K  R  R  R  H  E  E  E  M  G  F  R  R  S cggaatgtggatgtagagttggaggatgatgaggatgaggggggaggcgcagcgcctgaag
 R  N  V  D  V  E  L  E  D  D  E  D  E  G  E  A  Q  R  L  K cctgcgtatcctcctgttgctgatgacgggattagggtgaggggctatgatgacgagtat
 P  A  Y  P  P  V  A  D  D  G  I  R  V  R  G  Y  D  D  E  Y ccggagccctacacggatgaccgtatacagatgaccctgcggagccgatacggagacgg
 P  E  P  Y  T  D  D  P  Y  T  D  D  P  A  E  P  I  R  R  R agggaatacacggaggaggagagggaggagaggcggcggagaagaaaggagagagcgctt
 R  E  Y  T  E  E  E  R  E  E  R  R  R  R  R  K  E  R  A  L
```

-continued

```
gcggcaactgcggttgcaggaaggaacaagaaaagccgcgtcgtgagtggacctctactg
 A  A  T  A  V  A  G  R  N  K  K  S  R  V  V  S  G  P  L  L gaagagggcggcaaggaggattacgagtaccgtctcgcacagcgccgcggcggtggcggt
 E  E  G  G  K  E  D  Y  E  Y  R  L  A  Q  R  R  G  G  G  G ggtagcagcgatgtttattacgacgaagagctgaagaagaaaaagcgaaagaagatcttc
 G  S  S  D  V  Y  Y  D  E  E  L  K  K  K  K  R  K  K  I  F atcatcgtcggaatcatcgtgctcattctcgccattgtaatccctgtcgctgttgtagta
 I  I  V  G  I  I  V  L  I  L  A  I  V  P  V  A  V  V  V tcagggaaaaacaagggcagcgatggggatactgctgccgccacttcgtcggactcgagt
 S  G  K  N  K  G  S  D  G  D  T  A  A  A  T  S  S  D  S  S aaaccggacaacagcaatttgagcggcatatccgaagacgatatcccggagtatgcacga
 K  P  D  N  S  N  L  S  G  I  S  E  D  D  I  P  E  Y  A  R ggcggcctcctggaccccttcacttggtacgatacagaagacttcaacgtcaccttcacc
 G  G  L  L  D  P  F  T  W  Y  D  T  E  D  F  N  V  T  F  T aacgacacggtcggcggtctctcgattatgggcctcaattcgacatgggatgacagtgtc
 N  D  T  V  G  G  L  S  I  M  G  L  N  S  T  W  D  D  S  V caggccaacgaacatgtcccggctctgaacaaagagttcaagtacggtgaaatgccatc
 Q  A  N  E  H  V  P  A  L  N  K  E  F  K  Y  G  E  M  P  I cggggtgttaatgtgggcggctggctcaacattgaacgtggattacgccctctttcttt
 R  G  V  N  V  G  G  W  L  N  I  E  P  W  I  T  P  S  F  F gagtcctacaatacccgcgacggtgtcatcgacgaatggacgcttacgactagtatgggg
 E  S  Y  N  T  R  D  G  V  I  D  E  W  T  L  T  T  S  M  G ggaaaggccaaagcaaatctagaagaacactactcgtcatggatcactaagcagacctgg
 G  K  A  K  A  N  L  E  E  H  Y  S  S  W  I  T  K  Q  T  W gtggacattcgaaacgcgggcttcgaccacgtccgtattccgtttaactactgggctgtc
 V  D  I  R  N  A  G  F  D  H  V  R  I  P  F  N  Y  W  A  V accacgtatgacggagacccatacgttgccaaggtctcctggcggtaccttctacgcggc
 T  T  Y  D  G  D  P  Y  V  A  K  V  S  W  R  Y  L  L  R  G attgagtatgccaggcagaatggcctccgaatcaagttagatttgcacggcttgcctggt
 I  E  Y  A  R  Q  N  G  L  R  I  K  L  D  L  H  G  L  P  G agtcaaaatggctggaaccacagcggaagacaaggcgccatcggatggttaaacggcacg
 S  Q  N  G  W  N  H  S  G  R  Q  G  A  I  G  W  L  N  G  T gacggtacgctaaacgcgcagcgcagcattgaaatccatgatcagctgtcacagttcttc
 D  G  T  L  N  A  Q  R  S  I  E  I  H  D  Q  L  S  Q  F  F gctcagccacgctataagaacgttgttacgttgtacggcctggtgaatgaaccccgcatg
 A  Q  P  R  Y  K  N  V  V  T  L  Y  G  L  V  N  E  P  R  M gtggagctcaacacgaacgacgtcctttcttggtacgacgaggtcattccgaagattcgc
 V  E  L  N  T  N  D  V  L  S  W  Y  D  E  V  I  P  K  I  R cagaacaacatcacggccattcttgtctttggcgatggtttccttggcctggacaactgg
 Q  N  N  I  T  A  I  L  V  F  G  D  G  F  L  G  L  D  N  W cagggtaagctgcagaattacaaagacctcctgcttgacgtgcaccagtacgtcatcttc
 Q  G  K  L  Q  N  Y  K  D  L  L  L  D  V  H  Q  Y  V  I  F aacgtcgatctgatcaaattctcgcacgcggagaaggtcaactttgcctgcaaaggctgg
 N  V  D  L  I  K  F  S  H  A  E  K  V  N  F  A  C  K  G  W actcaacagtcgctgcggtccatgaacacggagaccggcttcggtccaactatgtgcgga
 T  Q  Q  S  L  R  S  M  N  T  E  T  G  F  G  P  T  M  C  G gagtggtctcaagccgacacggattgtacccagtacctcaacaatgtcggctggggtacc
 E  W  S  Q  A  D  T  D  C  T  Q  Y  L  N  N  V  G  W  G  T cgttgggagggcacctacaatacaggcaacagtagcacttccgtcctcgagcccacttgt
 R  W  E  G  T  Y  N  T  G  N  S  S  T  S  V  L  E  P  T  C cccacagacaacaacccgtctgctcctgcgaaaacgccaacgccgatccgtcaaactac
 P  T  D  N  N  P  V  C  S  C  E  N  A  N  A  D  P  S  N  Y agcgacacgtacaagaagttttgctgcacttcgcgctcgcccagatgtacagcttcgag
 S  D  T  Y  K  K  F  L  L  H  F  A  L  A  Q  M  Y  S  F  E
```

```
caaggctggggttggttctactggacgtgaagacggagaaggcggttcagtggagttgg
 Q  G  W  G  W  F  Y  W  T  W  K  T  E  K  A  V  Q  W  S  W gagagcgggatgaaggcgggcattctgcccgagaaggcgtgggatcgcagtgcatttcaa
 E  S  G  M  K  A  G  I  L  P  E  K  A  W  D  R  S  A  F  Q tgcaatacgactgatatcccggactattctggagaaggattgccggagaactactga
 C  N  T  T  D  I  P  D  Y  S  G  E  G  L  P  E  N  Y  -
```

SEQ ID NO: 159
LENGTH: 918
TYPE: PRT
ORGANISM: *M. phaseolina*

MPRDHDSPRRDRDRNYSRDRHPASGGEGYRSDRERRRRRRESRDPADDTPPRREQRAPRRHTRDPASDREYDT

DAARQQQQQQERRRRRGHRATDSTGEPILRQPERSYDSPYHSGSPSPRKKHAAAHRGRRERGSYGGGGDSSRW

TGTDTPASRDSGSSGRPLLHADALAQLDVMNSKSGWKANAYDEAYLKRVREQEAAMEKERQREQRRERRREKE

ARAMEREKRRRHEEEMGFRRSRNVDVELEDDEDEGEAQRLKPAYPPVADDGIRVRGYDDEYPEPYTDDPYTDD

PAEPIRRRREYTEEEREERRRRRKERALAATAVAGRNKKSRVVSGPLLEEGGKEDYEYRLAQRRGGGGGSSDV

YYDEELKKKKRKKIFIIVGIIVLILAIVIPVAVVVSGKNKGSDGDTAAATSSDSSKPDNSNLSGISEDDIPEY

ARGGLLDPFTWYDTEDFNVTFTNDTVGGLSIMGLNSTWDDSVQANEHVPALNKEFKYGEMPIRGVNVGGWLNI

EPWITPSFFESYNTRDGVIDEWTLTTSMGGKAKANLEEHYSSWITKQTWVDIRNAGFDHVRIPFNYWAVTTYD

GDPYVAKVSWRYLLRGIEYARQNGLRIKLDLHGLPGSQNGWNHSGRQGAIGWLNGTDGTLNAQRSIEIHDQLS

QFFAQPRYKNVVTLYGLVNEPRMVELNTNDVLSWYDEVIPKIRQNNITAILVFGDGFLGLDNWQGKLQNYKDL

LLDVHQYVIFNVDLIKFSHAEKVNFACKGWTQQSLRSMNTETGFGPTMCGEWSQADTDCTQYLNNVGWGTRWE

GTYNTGNSSTSVLEPTCPTDNNPVCSCENANADPSNYSDTYKKFLLHFALAQMYSFEQGWGWFYWTWKTEKAV

QWSWESGMKAGILPEKAWDRSAFQCNTTDIPDYSGEGLPENY*

SEQ ID NO: 160
LENGTH: 2978 (including 150 bp 5' UTR and 150 bp 3' UTR)
TYPE: DNA
ORGANISM: *M. phaseolina*

CCTATAACAAGTGTTTCGGTGCTGGGTGCTTATCACGTTTTATGTCTCTACTTCGATACTGGATATACCCGAA

GCCCTGAATAAAAAGCTAATTGCCTTTTCTCCTGCGTCAAGTCCCCGTCCTAGACCCTCTCCCGCCCAGCAGC

TACGATGGCCCCCTCGAAATTTCTATCGAGCTCCCAATCTCGCCAGTGGTTCAGTCTCCTCCGGCTGGCCCAG

ACCCGGAAACTTATGGGTACACTTCTCAAACATACCAGCGATATCCGCAGGTACTTGGCTATCCCTGGCCGCA

ATGCGCTCCTTATAGTTTCAATGCTCCCTCCGGCGGCTCGTGCCGCAGCAACTACACCTTTGTTCAGCCTCGT

CCAAAGAAGCCCACGGCACTCGAGTGTACCGACATTTTTGCCCCGCTCCAACACGATGACATACCCGCTCAGA

TAGAACCCGCCGGAAACCACCCAGTGCCTCGCAAGGGCATCGTCGACCCCGTGACGAAACCTACGCAGACCAA

CAAATTCCACGGGAACCTGTACCTGGACACACGTAACCAGACGGCTTGGACCCACCCATACTCCGTCGCGTGG

GCGCAAGGCTCTGGCAAGGCCGGGAGCTGGGGTCTTGCCGTGTCCCATATCGACCGGGACTTACTAGTCTTCG

GCAACGATACCGCTCAGGACTCTAAGACTTTCTTTGCTGCGCCAATCGGAATCCAGTCGCTGATCATTTCGGC

TGAAGAACTGGGCAATGGAACCGCCATGACACTTGATAATCTCGAGGCCTCTTCCGTCAACGTTAACCTCGCA

CCAGGTGCGGGAAGGCCACCCGTCATCACATACCCGCTCGTCCAGGGTATGGGGTTCGTGACTGGGATATTCA

AGGGAGCGAGACCTAAGATCCAAAGCAGCGTGCTGTTCCGCAAAGTAAAGGGACCGATCGCCGTCGGGGGGGT

CTTCAAATACCAGGTCACTCTCCGAGATGGAAAGAACTGGCTTATCTACGCAAAACCGGACCCTGGCTACGGC

ATTCCCGTCTTCAAGCTGGTAGACGCCACGACTCTAAGAGGGCCAAGAGGCTGGCGCGGCATCATCAGCGTCG

CCAAGAATCCCGCGAGTTCCGGGGCTGAAGAGACGTATGACAAGGCCGCCGGCGCTTACCCGACCGCGATGGC

AATCAAGGGCTCTGTCGACGGGACGACCGGGAAATACGAATTCAACTTCGTGAAGGCTGGCGACAGCTCCAGA

CCGTTGCTTATGTTCGCGCTTCCCCATCACGTGGAGAGTTTTGATGTCGAGACCCTCAGCACCCGTACGTCCA

TAGAGATGTACACTACCACCAAAGGCCTTGCAAAGGGGTTCTTGAGCGACAAGTGGACTATGGTAGAAGAGAA

-continued

CCTGTCGGTAAGCATGGGGTTCGCGCCGTGGACCCCAGACCGGGGCAGCATCGAAACCCTGTCGCGCGAAGCC

GCCTGCGTCGTCAACAATGCAGCAGTCCGTGAGCTCCAGGAGGATATAGTGGGCCAGACAAACCTCGATTCGA

TGTATTTCAGCGGCAAAGCCTTCGCCAAGTTCGCCGCCGTTATTTACGCTGTGCACGATTTGGCAGGGAACCC

ACAATTAGCACGTGAAGGTCTGGTTAGGCTGAAGAAGTCGCTGGCCCCGTTCATTCAAAATACTCAGCAAAAT

CCGCTTGTGTACGACACGACGTGGAGAGGCGTAGTGTCCACTGCGGGCTTCTCGGAACCATTGGCGGACTTTG

GCAGCACCTACTACAACGACCACCATTTTCACTACGGATATTTGTAAGTTCCGTTCCCTAACGCTCTCCTGAG

TCCATGTTTCCCGTGACGGCGCAAAGCTAAAACGCACTACGTAGCGTCTACACCGCGGCAGTGATCGCGTATT

TAGACCCGTCCTGGCTCTCGGAAGGGACCAACAAGGCTTGGATAGACATGCTTGTCAGAGACTATGCCAACCC

GGTCGATGACGGTGATTTTCCCTTCAGCCGCGCATTTGACTGGTTCCAGTAAGTACAAAATTGTTCGTTTGAT

AACATAGTCATTGGGGTTTAACATTTTCCTAGTGGCCACAGTTGGGCAAAAGGAGTCTTCTCCTCAATTGACG

GAAAAGACCAAGAGTCGACATCTGAGGTACGCTGAACCTTATACAGAGTGACGATGTACGTTTTACTGACTAT

ATTTGCGCAACTGTCAGGACTCGTTCGCAACTTACTCCATGAAAATGTGGGGCCGAGTAACGGGTGACGTCGC

TTTGGAGGCGAGAGGTATGACTCATTTTATGTCTACTACCGGGTAACGTAGAGATGCTGACGGGCACTTTAAG

CAACGCTTATGCTAAGCATACAGGCTCGGAGCTTCCAGAACTATTTCCTAATGGAAGAAGACAACGCTAACCA

GCCGCGAGAGATGATCAATAACAAAGTGACTGGCATCTTATGGGAGAATCGAGTGGCCTGGACTACTTACTTC

GGAGATTTTTGGTTTTATAAGCAGGGGTAGGTCCTTATTTCCCCTATGCGAAGGCCTCGTGACTGACTATGTG

CACAGCATCCACATGATCCCCGTCcATGTGCCGTCAACTCTGATCCGCACAAAGCAATTTGTGCAAGAGGAAT

ATGACATATTCTTAAGCAATGGCGCCATTGATACTGCCCAAGAGGGTTGGAGGGGTATTCTCTATGCCAACCT

CGCTCTTATCGATGCGGACACTTCATACGACTTCTTTTCGGACCCTTCCTTCAACACCACTTACTTAGATGGG

GGCGCTAGCCGGACCTGGTATTTGGCTTATGTGTCTGCCCTAAGGGGTCATTGAGGGTGGACACTAAATCTTA

AGAGCGTTATCCCTATGCGCTTGCTTTTCCTTTTACATCGCAGCCCTTCTACCGCATCCTCTTTCCTCTCTCT

TTCTTTTTTTAGTTTCTACAAATATTATAGATATTTAACAATTTCCTGAATGTTTCTA

SEQ ID NO: 161
LENGTH: 2334
TYPE: DNA
ORGANISM: *M. phaseolina*
FEATURE NAME/KEY: CDS
LOCATION: (1)...(2334)

```
atggcccccctcgaaatttctatcgagctcccaatctcgccagtggttcagtctcctccgg
 M  A  P  S  K  F  L  S  S  S  Q  S  R  Q  W  F  S  L  L  R ctggcccagacccggaaacttatgggtacacttctcaaacataccagcgatatccgcagt
 L  A  Q  T  R  K  L  M  G  T  L  L  K  H  T  S  D  I  R  S ttcaatgctccctccggcggctcgtgccgcagcaactacacctttgttcagcctcgtcca
 F  N  A  P  S  G  G  S  C  R  S  N  Y  T  F  V  Q  P  R  P aagaagcccacggcactcgagtgtaccgacatttttgccccgctccaacacgatgacata
 K  K  P  T  A  L  E  C  T  D  I  F  A  P  L  Q  H  D  D  I cccgctcagatagaacccgccggaaaccacccagtgcctcgcaagggcatcgtcgacccc
 P  A  Q  I  E  P  A  G  N  H  P  V  P  R  K  G  I  V  D  P gtgacgaaacctacgcagaccaacaaattccacgggaacctgtacctggacacacgtaac
 V  T  K  P  T  Q  T  N  K  F  H  G  N  L  Y  L  D  T  R  N cagacggcttggacccacccatactccgtcgcgtgggcgcaaggctctggcaaggccggg
 Q  T  A  W  T  H  P  Y  S  V  A  W  A  Q  G  S  G  K  A  G agctggggtcttgccgtgtcccatatcgaccgggacttactagtcttcggcaacgatacc
 S  W  G  L  A  V  S  H  I  D  R  D  L  L  V  F  G  N  D  T gctcaggactctaagactttctttgctgcgccaatcggaatccagtcgctgatcatttcg
 A  Q  D  S  K  T  F  F  A  A  P  I  G  I  Q  S  L  I  I  S gctgaagaactgggcaatggaaccgccatgacacttgataatctcgaggcctcttccgtc
 A  E  E  L  G  N  G  T  A  M  T  L  D  N  L  E  A  S  S  V
```

```
-continued
aacgttaacctcgcaccaggtgcgggaaggccacccgtcatcacatacccgctcgtccag
 N  V  N  L  A  P  G  A  G  R  P  P  V  I  T  Y  P  L  V  Q ggtatggggttcgtgactgggatattcaagggagcgagacctaagatccaaagcagcgtg
 G  M  G  F  V  T  G  I  F  K  G  A  R  P  K  I  Q  S  S  V ctgttccgcaaagtaaagggaccgatcgccgtcgggggggtcttcaaataccaggtcact
 L  F  R  K  V  K  G  P  I  A  V  G  G  V  F  K  Y  Q  V  T ctccgagatggaaagaactggcttatctacgcaaaaccggaccctggctacggcattccc
 L  R  D  G  K  N  W  L  I  Y  A  K  P  D  P  G  Y  G  I  P gtcttcaagctggtagacgccacgactctaagagggccaagaggctggcgcggcatcatc
 V  F  K  L  V  D  A  T  T  L  R  G  P  R  G  W  R  G  I  I agcgtcgccaagaatcccgcgagttccggggctgaagagacgtatgacaaggccgccggc
 S  V  A  K  N  P  A  S  S  G  A  E  E  T  Y  D  K  A  A  G gcttacccgaccgcgatggcaatcaagggctctgtcgacgggacgaccgggaaatacgaa
 A  Y  P  T  A  M  A  I  K  G  S  V  D  G  T  T  G  K  Y  E ttcaacttcgtgaaggctggcgacagctccagaccgttgcttatgttcgcgcttccccat
 F  N  F  V  K  A  G  D  S  S  R  P  L  L  M  F  A  L  P  H cacgtggagagttttgatgtcgagaccctcagcacccgtacgtccatagagatgtacact
 H  V  E  S  F  D  V  E  T  L  S  T  R  T  S  I  E  M  Y  T accaccaaaggccttgcaaaggggttcttgagcgacaagtggactatggtagaagagaac
 T  T  K  G  L  A  K  G  F  L  S  D  K  W  T  M  V  E  E  N ctgtcggtaagcatggggttcgcgccgtggaccccagaccggggcagcatcgaaaccctg
 L  S  V  S  M  G  F  A  P  W  T  P  D  R  G  S  I  E  T  L tcgcgcgaagccgcctgcgtcgtcaacaatgcagcagtccgtgagctccaggaggatata
 S  R  E  A  A  C  V  V  N  N  A  A  V  R  E  L  Q  E  D  I gtgggccagacaaacctcgattcgatgtatttcagcggcaaagccttcgccaagttcgcc
 V  G  Q  T  N  L  D  S  M  Y  F  S  G  K  A  F  A  K  F  A gccgttatttacgctgtgcacgatttggcagggaacccacaattagcacgtgaaggtctg
 A  V  I  Y  A  V  H  D  L  A  G  N  P  Q  L  A  R  E  G  L gttaggctgaagaagtcgctggccccgttcattcaaaatactcagcaaaatccgcttgtg
 V  R  L  K  K  S  L  A  P  F  I  Q  N  T  Q  Q  N  P  L  V tacgacacgacgtggagaggcgtagtgtccactgcgggcttctcggaaccattggcggac
 Y  D  T  T  W  R  G  V  V  S  T  A  G  F  S  E  P  L  A  D tttggcagcacctactacaacgaccaccattttcactacggatatttcgtctacaccgcg
 F  G  S  T  Y  Y  N  D  H  H  F  H  Y  G  Y  F  V  Y  T  A gcagtgatcgcgtatttagacccgtcctggctctcggaagggaccaacaaggcttggata
 A  V  I  A  Y  L  D  P  S  W  L  S  E  G  T  N  K  A  W  I gacatgcttgtcagagactatgccaacccggtcgatgacggtgattttcccttcagccgc
 D  M  L  V  R  D  Y  A  N  P  V  D  D  G  D  F  P  F  S  R gcatttgactggttccatggccacagttgggcaaaaggagtcttctcctcaattgacgga
 A  F  D  W  F  H  G  H  S  W  A  K  G  V  F  S  S  I  D  G aaagaccaagagtcgacatctgaggactcgttcgcaacttactccatgaaaatgtgggc
 K  D  Q  E  S  T  S  E  D  S  F  A  T  Y  S  M  K  M  W  G cgagtaacgggtgacgtcgctttggaggcgagagcaacgcttatgctaagcatacaggct
 R  V  T  G  D  V  A  L  E  A  R  A  T  L  M  L  S  I  Q  A cggagcttccagaactatttcctaatggaagaagacaacgctaaccagccgcgagagatg
 R  S  F  Q  N  Y  F  L  M  E  E  D  N  A  N  Q  P  R  E  M atcaataacaaagtgactggcatcttatgggagaatcgagtggcctggactacttacttc
 I  N  N  K  V  T  G  I  L  W  E  N  R  V  A  W  T  T  Y  F ggagattttggttttataagcagggcatccacatgatccccgtccatgtgccgtcaact
 G  D  F  W  F  Y  K  Q  G  I  H  M  I  P  V  H  V  P  S  T ctgatccgcacaaagcaatttgtgcaagaggaatatgacatattcttaagcaatggcgcc
 L  I  R  T  K  Q  F  V  Q  E  E  Y  D  I  F  L  S  N  G  A attgatactgcccaagagggttggaggggtattctctatgccaacctcgctcttatcgat
 I  D  T  A  Q  E  G  W  R  G  I  L  Y  A  N  L  A  L  I  D
```

-continued
```
gcggacacttcatacgacttcttttcggacccttccttcaacaccacttacttagatggg
 A  D  T  S  Y  D  F  F  S  D  P  S  F  N  T  T  Y  L  D  G ggcgctagccggacctggtatttggcttatgtgtctgccctaaggggtcattga
 G  A  S  R  T  W  Y  L  A  Y  V  S  A  L  R  G  H  -
```

SEQ ID NO: 162
LENGTH: 777
TYPE: PRT
ORGANISM: *M. phaseolina*
MAPSKFLSSSQSRQWFSLLRLAQTRKLMGTLLKHTSDIRSFNAPSGGSCRSNYTFVQPRPKKPTALECTDIFA

PLQHDDIPAQIEPAGNHPVPRKGIVDPVTKPTQTNKFHGNLYLDTRNQTAWTHPYSVAWAQGSGKAGSWGLAV

SHIDRDLLVFGNDTAQDSKTFFAAPIGIQSLIISAEELGNGTAMTLDNLEASSVNVNLAPGAGRPPVITYPLV

QGMGFVTGIFKGARPKIQSSVLFRKVKGPIAVGGVFKYQVTLRDGKNWLIYAKPDPGYGIPVFKLVDATTLRG

PRGWRGIISVAKNPASSGAEETYDKAAGAYPTAMAIKGSVDGTTGKYEFNFVKAGDSSRPLLMFALPHHVESF

DVETLSTRTSIEMYTTTKGLAKGFLSDKWTMVEENLSVSMGFAPWTPDRGSIETLSREAACVVNNAAVRELQE

DIVGQTNLDSMYFSGKAFAKFAAVIYAVHDLAGNPQLAREGLVRLKKSLAPFIQNTQQNPLVYDTTWRGVVST

AGFSEPLADFGSTYYNDHHFHYGYFVYTAAVIAYLDPSWLSEGTNKAWIDMLVRDYANPVDDGDFPFSRAFDW

FHGHSWAKGVFSSIDGKDQESTSEDSFATYSMKMWGRVTGDVALEARATLMLSIQARSFQNYFLMEEDNANQP

REMINNKVTGILWENRVAWTTYFGDFWFYKQGIHMIPVHVPSTLIRTKQFVQEEYDIFLSNGAIDTAQEGWRG

ILYANLALIDADTSYDFFSDPSFNTTYLDGGASRTWYLAYVSALRGH*

SEQ ID NO: 163
LENGTH: 3445 (including 150 bp 5' UTR and 150 bp 3' UTR)
TYPE: DNA
ORGANISM: *M. phaseolina*
CTCTGGAATTTCCTTTCTTGGCGAGAGCCACAACCATTTTTCTTCTTCCTCCGCCAGATCCCTGATATGGCAT

TCCCAACTTCTTTATCTTTTCTGTATCTCATTAACATGCTTTGCTTTGCCGCGGGAGCAACCGTCTTTCTGAC

AACCATGCAGTTCCAAGGCGCAGCGGCCCATCCGCTGGCCCAGCCTCAGCTGCTTGAAGACAGTACGTACTCG

GCAAGCGCACCATCAGCAGGGAAACTCAGCCGGGTCCCGACACCTGTCTGCAACAACTCTCCCCCATTGACCG

TCACCAAAACCGTCTACGGTGCCTCATACGAATTGACGACACCGTCCTCTTGCTTGTCGACCACAACTAACCA

GATAACTTCTTGTGCCACGTCAGGTTTTCCCTCCCTATATACTGCTTCTTCCGCAGACCTAACGCCGACTTCG

ACTCCTACGACCCCTACGTCTATTGCGGCCCCCTTTGAACTCTCTATCGGCGCTACCGCCTCTCCTATTTTGC

AGTCCATTGCTCCTCCCCTTGAACCGCAACCGACTGGCATCGTCCATACAACGCTCGAGCTGTATCCCCAAGT

TACCACTGGAGTTCCGTGGCATCGCATATGTAAGCCTTCAGTCTCAGTTCGCGCTGGCGTTCCTCCAGAGCTG

GAATTGGCTTGTTCAACGCTCAGCTCACTTCCTGCCCTTCTCGGCATCCAGCGGAAATTATGATTTGCTTTCA

GCTGCCGTTTCATCCCCGGCTTTTTCTGGGCGAATGCTAATGACACACGTCAGCGCCTACTCCTGCACCCAAC

GTCGCTGCTTGTCGAAACAACTACAGTCGTCCTCTGACTCCAGTCTACCAACCGAATCCGAACGCATATCCAT

ACAAGTTTAACAGCATGGATTCGGCTAACATCTTCGCCGCCGTCCCGGGCGATGCGTCCATTCCCTCGCAGAT

AGCGCCGCGATCACCTCATCCACAGCCATTTTTGGGCATTGAGGGTGCTGGAACTACCCCGTTGCAGACCAAC

AAGTTCTATGCCAACCTGTTTCTGGGTCAGAGGAACCAGTCCGTCTGGACCCACCCCTACTCTGTTTCCAAAT

CCATTGGACAGTCTCCGGCTGGAAGCTGGGGCCTCGCAGTATCCCACATTGACCGCTCTCAACTTGCATTTGG

ACCGGCCACGGACCAAGACAGTGCTCGTTTCTTCATTTCCCCAATCGGGATCCAGTCCCTGATTCTCTCTGCC

ACAGAACTTGGGCCCAACAGCAACATGACTGTGGACACGCTTGAGGACATGTCTGTCAATCTCAACTTGGCTC

CTAGTGTTGGTGCACAGCCCATCATCACATTCCCAGTAGTTCAAGGTATGGGCTTCGTTACTGGCATCTACAA

GAACGCACAGCCAAGCATCGATTCTGGTGTCTTCTACCGCAACGTTAGCGGGCCTTTCCAGCTTGGCAGCACC

TACAAGTACAGCATTCTTCTGGAAGACGGCAAGAACTGGGTTCTGTACGCCACTCCTGACAGCGCAAATGGTG

CTCCTGTGTTCTCTCTGGACTCCAACACCACGCTGACCGGGCCCGCTAACTGGAGTGGAACCATCATGGTTTC

GAAGAACACGGCAGGTGCCGACGGCGAGGCAGTCCTTGACAGATCTGCCGGTGTCTACCCTGTATCGGTCGAC

-continued

```
ATCTTCGGCAGCGCCTCCGGTGCCGCCGCTCAGTATGGCTTCCGCTTTGGCAAGGCTGGCGAGGTCCAGAAGA
CTTTGTTCCACTACGCACTGCCGCATCACGTCCAGAGCTTCGATGCCAACACCGCCGCAAGACAAACTCTACT
TACATTGAACACTACCACCAAGGGCATTGCAACTGGTTTTACAGCCGACAGCTGGACCATGGTTGAGCCAAAT
CTTCCCGTGGATATGAGCTTTGCCCCGTGGTCGCTTGACCGAGGCAACCTCCCGACTATCTCGGCCACTGCTC
AGTGTGCGGTTGTTGCGGCTGCCGAGGCTGAGTTACAGCAGGATATTCCAGCGCAGACGAACCTTGACTCGAT
GTATTTCAGCGGCAAAGGTCTTGCCAAGTTTGCAACTATTGTCTATGCTGCCCGGGACCTCGGGGGCAACGCT
GAGCTTGCCAACCAGGGACTCAAGGAGCTCAAGGCTGCCTTTGATGTTTTCGTCAACAACCAACAGAGGAATC
CGCTCGTGTACGACAGCTCGTGGAAGGGTGTTGTCTCCAGTGCTGGCTACGGGGATCCCAACGCGGACTTTGG
CAACTCGTACTACAACGACCATCACTTCCATTACGGATACCAGTAGGTCACACCGCGGCTGGAGTCTATGCTT
TTACTGATCAGGCTGCAGTGTGTACACGGCTGCCGTGATCGGGTACCTTGATCCGTCCTGGCTCACCGAGAAG
AACGTCAACTATGTGAACACTCTGGCGAGGGACTTTGCGAACCCAATTCGTAGCAGCCAATTTCCTTTCAGCC
GCGCCTTCGACTGGTTTAAGTGAGTTGCTCGGCCTTCGGTCGCTTTAGTACGGCGCTAACGCATGGCAGTGGG
CATAGTTGGGCAAAGGGCCTCTTCGAATCTGCTGATGGCAAGGATCAGGAGTCATCTTCTGAGGTCAGTCACC
GAGTACCTCCACGCTGTGCGGGAACTGACCACGCATAGGATTCTTTCGCGTCGTACGGTCTGAAGTTGTGGGG
TAAGGTCATCGGAGATGCTAACATGGAGGCAAGAGGTGAGTCGATGCAGCGAGCGTCTGATGGGCGTTGTTGA
CACGAGGTTCGGCAGCGACCCTGATGCTGGCTATTCAAAATCGAAGCTTCAACAACTATTTCCTGATGCAGAG
CTCGAACACGATTCAGCCTCGGCAGATTATCAACAACAAGGTGACTGGCATTCTATTCGAGAATAAGGTCGAC
TGGGCTACGTACTTTAGCGATGCATGGTGGTGCAAGCAGGGGTATGTTACAGTCACAACGGAAGCAGTGCAGG
CTCCCAAGCACACGGCACTGACTTACGGCTGCAGAATCCACATGATCCCTGTCCATGTCCCCTCGGCATACAT
CAGGAAACCGAGTTTTGTCAGAGAGGAGTACGACACTTTCATGAGCAACGGGCGTATTGCACAGGCCGAGGGC
GGCTGGAGAGGCATTCTGGAGTCCAACCTGGCGCTCGTCGATCCAGGCACAGCGTACAACTTCTTCGCGGACC
CGAACTTCAACATGACGCTTCTGGACGGCGGAGCAAGCTTAACGTGGTACCTCGCATATTCGGCAGCGCTTGC
GGGATTGTGAAACTGAGGTGCCGGGACGGAATAATTTCTTGCTTTAACGATTCTTCCCCCTATGGTATTGTCC
TTCCTACCGCTCGGCCTTTGGTTTCTTCCTGGCGCACGGGCAGGCCCGTTGTCAACCCTTTTAAACTTCACCT
AAGTAGCTTTGTTC
```

SEQ ID NO: 164
LENGTH: 2529
TYPE: DNA
ORGANISM: *M. phaseolina*
FEATURE NAME/KEY: CDS
LOCATION: (1)...(2529)

```
atgcagttccaaggcgcagcggcccatccgctggcccagcctcagctgcttgaagacagt
 M   Q   F   Q   G   A   A   A   H   P   L   Q   P   Q   L   L   E   D   S tttccctccctatatactgcttcttccgcagacctaacgccgacttcgactcctacgacc
 F   P   S   L   Y   T   A   S   S   A   D   L   T   P   T   S   T   P   T   T cctacgtctattgcggccccctttgaactctctatcggcgctaccgcctctcctattttg
 P   T   S   I   A   A   P   F   E   L   S   I   G   A   T   A   S   P   I   L cagtccattgctcctcccttgaaccgcaaccgactggcatcgtccatacaacgctcgag
 Q   S   I   A   P   P   L   E   P   Q   P   T   G   I   V   H   T   T   L   E ctgtatccccaagttaccactggagttccgtggcatcgcatatcgcctactcctgcaccc
 L   Y   P   Q   V   T   T   G   V   P   W   H   R   I   S   P   T   P   A   P aacgtcgctgcttgtcgaaacaactacagtcgtcctctgactccagtctaccaaccgaat
 N   V   A   A   C   R   N   N   Y   S   R   P   L   T   P   V   Q   P   N ccgaacgcatatccatacaagtttaacagcatggattcggctaacatcttcgccgccgtc
 P   N   A   Y   P   Y   K   F   N   S   M   D   S   A   N   I   F   A   A   V ccgggcgatgcgtccattccctcgcagatagcgccgcgatcacctcatccacagccattt
 P   G   D   A   S   I   P   S   Q   I   A   P   R   S   P   H   P   Q   P   F
```

-continued

```
ttgggcattgagggtgctggaactaccccgttgcagaccaacaagttctatgccaacctg
 L  G  I  E  G  A  G  T  T  P  L  Q  T  N  K  F  Y  A  N  L tttctgggtcagaggaaccagtccgtctggacccaccccactctgtttccaaatccatt
 F  L  G  Q  R  N  Q  S  V  W  T  H  P  Y  S  V  S  K  S  I ggacagtctccggctggaagctggggcctcgcagtatcccacattgaccgctctcaactt
 G  Q  S  P  A  G  S  W  G  L  A  V  S  H  I  D  R  S  Q  L gcatttggaccggccacggaccaagacagtgctcgtttcttcatttccccaatcgggatc
 A  F  G  P  A  T  D  D  Q  D  S  A  R  F  F  I  S  P  I  G  I cagtccctgattctctctgccacagaacttgggcccaacagcaacatgactgtggacacg
 Q  S  L  I  L  S  A  T  E  L  G  P  N  S  N  M  T  V  D  T cttgaggacatgtctgtcaatctcaacttggctcctagtgttggtgcacagcccatcatc
 L  E  D  M  S  V  N  L  N  L  A  P  S  V  G  A  Q  P  I  I acattcccagtagttcaaggtatgggcttcgttactggcatctacaagaacgcacagcca
 T  F  P  V  V  Q  G  M  G  F  V  T  G  I  Y  K  N  A  Q  P agcatcgattctggtgtcttctaccgcaacgttagcgggcctttccagcttggcagcacc
 S  I  D  S  G  V  F  Y  R  N  V  S  G  P  F  Q  L  G  S  T tacaagtacagcattcttctggaagacggcaagaactgggttctgtacgccactcctgac
 Y  K  Y  S  I  L  L  E  D  G  K  N  W  V  L  Y  A  T  P  D agcgcaaatggtgctcctgtgttctctctggactccaacaccacgctgaccgggcccgct
 S  A  N  G  A  P  V  F  S  L  D  S  N  T  T  L  T  G  P  A aactggagtggaaccatcatggtttcgaagaacacggcaggtgccgacggcgaggcagtc
 N  W  S  G  T  I  M  V  S  K  N  T  A  G  A  D  G  E  A  V cttgacagatctgccggtgtctaccctgtatcggtcgacatcttcggcagcgcctccggt
 L  D  R  S  A  G  V  Y  P  V  S  V  D  I  F  G  S  A  S  G gccgccgctcagtatggcttccgctttggcaaggctggcgaggtccagaagactttgttc
 A  A  A  Q  Y  G  F  R  F  G  K  A  G  E  V  Q  K  T  L  F cactacgcactgccgcatcacgtccagagcttcgatgccaacaccgccgcaagacaaact
 H  Y  A  L  P  H  H  V  Q  S  F  D  A  N  T  A  A  R  Q  T ctacttacattgaacactaccaccaagggcattgcaactggttttacagccgacagctgg
 L  L  T  L  N  T  T  T  K  G  I  A  T  G  F  T  A  D  S  W accatggttgagccaaatcttcccgtggatatgagctttgccccgtggtcgcttgaccga
 T  M  V  E  P  N  L  P  V  D  M  S  F  A  P  W  S  L  D  R ggcaacctcccgactatctcggccactgctcagtgtgcggttgttgcggctgccgaggct
 G  N  L  P  T  I  S  A  T  A  Q  C  A  V  V  A  A  A  E  A gagttacagcaggatattccagcgcagacgaaccttgactcgatgtatttcagcggcaaa
 E  L  Q  Q  D  I  P  A  Q  T  N  L  D  S  M  Y  F  S  G  K ggtcttgccaagtttgcaactattgtctatgctgcccgggacctcggggggcaacgctgag
 G  L  A  K  F  A  T  I  V  Y  A  A  R  D  L  G  G  N  A  E cttgccaaccagggactcaaggagctcaaggctgcctttgatgttttcgtcaacaaccaa
 L  A  N  Q  G  L  K  E  L  K  A  A  F  D  V  F  V  N  N  Q cagaggaatccgctcgtgtacgacagctcgtggaagggtgttgtctccagtgctggctac
 Q  R  N  P  L  V  Y  D  S  S  W  K  G  V  V  S  S  A  G  Y ggggatcccaacgcggactttggcaactcgtactacaacgaccatcacttccattacgga
 G  D  P  N  A  D  F  G  N  S  Y  Y  N  D  H  H  F  H  Y  G taccatgtgtacacggctgccgtgatcgggtaccttgatccgtcctggctcaccgagaag
 Y  H  V  Y  T  A  A  V  I  G  Y  L  D  P  S  W  L  T  E  K aacgtcaactatgtgaacactctggcgagggactttgcgaacccaattcgtagcagccaa
 N  V  N  Y  V  N  T  L  A  R  D  F  A  N  P  I  R  S  S  Q tttcctttcagccgcgccttcgactggtttaatgggcatagttgggcaaagggcctcttc
 F  P  F  S  R  A  F  D  W  F  N  G  H  S  W  A  K  G  L  F gaatctgctgatggcaaggatcaggagtcatcttctgaggattcttttcgcgtcgtacggt
 E  S  A  D  G  K  D  Q  E  S  S  S  E  D  S  F  A  S  Y  G ctgaagttgtggggtaaggtcatcggagatgctaacatggaggcaagagcgaccctgatg
 L  K  L  W  G  K  V  I  G  D  A  N  M  E  A  R  A  T  L  M
```

-continued

```
ctggctattcaaaatcgaagcttcaacaactatttcctgatgcagagctcgaacacgatt
 L  A  I  Q  N  R  S  F  N  N  Y  F  L  M  Q  S  S  N  T  I cagcctcggcagattatcaacaacaaggtgactggcattctattcgagaataaggtcgac
 Q  P  R  Q  I  I  N  N  K  V  T  G  I  L  F  E  N  K  V  D tgggctacgtactttagcgatgcatggtggtgcaagcagggaatccacatgatccctgtc
 W  A  T  Y  F  S  D  A  W  W  C  K  Q  G  I  H  M  I  P  V catgtcccctcggcatacatcaggaaaccgagttttgtcagagaggagtacgacactttc
 H  V  P  S  A  Y  I  R  K  P  S  F  V  R  E  E  Y  D  T  F atgagcaacgggcgtattgcacaggccgagggcggctggagaggcattctggagtccaac
 M  S  N  G  R  I  A  Q  A  E  G  G  W  R  G  I  L  E  S  N ctggcgctcgtcgatccaggcacagcgtacaacttcttcgcggacccgaacttcaacatg
 L  A  L  V  D  P  G  T  A  Y  N  F  F  A  D  P  N  F  N  M acgcttctggacggcggagcaagcttaacgtggtacctcgcatattcggcagcgcttgcg
 T  L  L  D  G  G  A  S  L  T  W  Y  L  A  Y  S  A  A  L  A ggattgtga
 G  L  -
```

SEQ ID NO: 165
LENGTH: 842
TYPE: PRT
ORGANISM: *M. phaseolina*

MQFQGAAAHPLAQPQLLEDSFPSLYTASSADLTPTSTPTTPTSIAAPFELSIGATASPILQSIAPPLEPQPTG

IVHTTLELYPQVTTGVPWHRISPTPAPNVAACRNNYSRPLTPVYQPNPNAYPYKFNSMDSANIFAAVPGDASI

PSQIAPRSPHPQPFLGIEGAGTTPLQTNKFYANLFLGQRNQSVWTHPYSVSKSIGQSPAGSWGLAVSHIDRSQ

LAFGPATDQDSARFFISPIGIQSLILSATELGPNSNMTVDTLEDMSVNLNLAPSVGAQPIITFPVVQGMGFVT

GIYKNAQPSIDSGVFYRNVSGPFQLGSTYKYSILLEDGKNWVLYATPDSANGAPVFSLDSNTTLTGPANWSGT

IMVSKNTAGADGEAVLDRSAGVYPVSVDIFGSASGAAAQYGFRFGKAGEVQKTLFHYALPHHVQSFDANTAAR

QTLLTLNTTTKGIATGFTADSWTMVEPNLPVDMSFAPWSLDRGNLPTISATAQCAVVAAAEAELQQDIPAQTN

LDSMYFSGKGLAKFATIVYAARDLGGNAELANQGLKELKAAFDVFVNNQQRNPLVYDSSWKGVVSSAGYGDPN

ADFGNSYYNDHHFHYGYHVYTAAVIGYLDPSWLTEKNVNYVNTLARDFANPIRSSQFPFSRAFDWFNGHSWAK

GLFESADGKDQESSSEDSFASYGLKLWGKVIGDANMEARATLMLAIQNRSFNNYFLMQSSNTIQPRQIINNKV

TGILFENKVDWATYFSDAWWCKQGIHMIPVHVPSAYIRKPSFVREEYDTFMSNGRIAQAEGGWRGILESNLAL

VDPGTAYNFFADPNFNMTLLDGGASLTWYLAYSAALAGL*

SEQ ID NO: 166
LENGTH: 3878 (including 150 bp 5' UTR and 150 bp 3' UTR)
TYPE: DNA
ORGANISM: *M. phaseolina*

CGTTCAGCATCGTCGCTTCAGCGTGCGTGTCATGTCTTCTTGACGAATCAGCCTTGGCGTTCTGTAGCCTCAT

CCTCAGCCTCGCATTGGGTACATATCGGTCTTTGTTTTCGTTATTTCAATTTTCTGTGGTGTTTTTCAGGTCT

CAAAATGCCTTGGGCCGGCCAAGACAAAACTTACACTTCCAGCGACGAGACGCATCCGAAGCACCGCGACCCA

TTCCGGTTTATCCCCGCGGACGACTTCTACGAGTTCTTTTCTGGAAAGCACCGCCCAACATCAGTTACATGCA

AGCCAGAAGATCAAGCCGTCGAGGACAAGACGAGGAATGCGGCATGCCACAATGGCAGGATCTTCCGCTTTAA

CGATGACACACTTATGCTCATTCAATTCATCCGGCCTCTTGTTTGGAGAATCCAGTTTGATCCGAATCGCCAA

AAAGGGTCGGAGTACACGGACTGGAATACGTGAGTTTTGCCGGATATCTAAATGCAGCTAGTCCGCTTACAGT

CTGCAGAAAGTCATTACTGGAGGGAAGATTGTCCAAAATGACGCGCGTTCTCGACACTGCAGAAGAGATAGTC

TGGGATGTCGAGTTTGACCCTACTCACGTCACGCATTTCATCCTTCGCTCGATCATTGTCTCCAGAGGGAAGC

GAGTTCCCGTTGTTGAGTTATGGATTCAGCGAAATCCATTTAGAATCACCGCTATTCGGCGGATCAAACCCG

GTTGACGCCGGAAGTTTCTCCTTATGGTGACATCTCAGTTGATATTCCGGGCCCTGGAAGAGCCATCATCTGG

CAGACAACGGAGAACCCCCTACGGCACGACGGGCGGGCTACAATACTCTCAGTCGAGAAGAAACCGCAGGCAA

AGTACATGGGCTTTGGTGGCCAAGGCGGAAAAAACTTGTTCAAAGATAACACTTACCTGAACTACTTCAGTGA
```

-continued
```
GACATCAGCCCCTTTCTGATGGAACAGGCTCGCCTAATCATGGACCCAGATTTCGATAACATGCGGTACAACA
ATATCTACGCTAAGGGGCCTGAAGAGGCCGCAGAACCATTGTACCATTCGGAGCCCTTTTGGATCGAAATCAA
CAGGCATCCAAGCTACATGTCCCAGGTGGCAACTTTCATCGACAATTTCTCCCAAGTCTGCCTTGATGTCGGC
AAGACTGACAGGAGCTCCTTCCGCATTGCAACCAGATTCAACAGCTTCCAAGCTATTTTCATGGCCGGTAACA
CCATTGCGGAGATCATCAGATTGTATACTTCCCTGATCGGCAAACCAAGGCTGATGCCTCGATACGTCCTTGG
AAATCACCAAGGCTGCTATGGATATGACCGTCAATGGAAGGTTGAAGAGGTGGTACGAAAATACCGCGAGTAT
GATATTCCGCTGGACGGGATGCACATCGACGTTGACATGCAGAGAGGATACCGCACATTTACAATTGATAGGG
ACAGATTTCCTGAGCCGGAGAAGATGTTCCTTGAATTGCGTAAGCAAGGCGTGCGTTGCAGCACCAACATCAC
GCCTGTCATCAACTGCATACCTGACACCTCTTACGTCCCTCTGAACGAAGGCCTGGCTGAGAATCATTTTGTT
CTGGACAAAAGGGATATCGATCCATCAGCGCCAACTTGCCATGACCAGAGGTATATGCAGTACGGAAATGCGG
ATCTTTACTTTACAAACCCGAATGATGTGGACCGCAGGCCTTACCCAGATGAATACGACTTTGAGGCTCACTT
CAACAAATCCGTTCCTTTCCACGGGGCGTCTCCTACGGCGATGGGCAAGGTGCACCAGGCCATTACCCGAAT
CTGAACAACAAGCGCACTCGAGAATGGTGGGGAAAGCAGTACAAAGACCTCTTCGACGCAGGGCTTGAGTTCA
TCTGGCAGGACATGACGTCCCCTTGCATAGGTGATGCATACGGAGACATGAAGTCGTGGCCGTTCCGGCTTCT
ACTCGAGTCTGACAGCTGGCGAGGAGAACAACGCCGCAGGAGACTCAGCATTCCGGCACCTGCCGATAAGGAA
GAGCTCAAGACTGCTATCGAGCTTTGGTCACTGTATAGCCTCAACCTACATAAGGCGACTTTTAAAGGGCTCA
AGCGGTTGGAAAGCCGGAAAGGAAAGCGGAACTTCATCATTGGAAGGGGCAGTTTCGCCGGCGCCCAGCGCTA
TGCCGGACTCTGGACTGGCGATAATGCATCTACTTGGGAGTTCCTCAGTGTCTCAATCTCGCAGGTCCTTTCT
CTTGGTCTTTCAGGCATGACGATGGCTGGCGCTGATGTTGGGGGTTTTGAGCTTGCGCTTGGAGAGTCGAAGT
TCGCCGATCCTGAGCTTCTGATCCGCTGGTACTGTGCGAACAGCTTACTTCCGTGGTTTAGGTGAGCAATGAA
GCTCCTTTAAACAGAACAAATGCTAACGAACTGCAGGAATCATTACAGTGGGAGGCACGAACCTTTCGAGGAT
CGACCAGATCAGCCGCGGGATTGTGACAAGAAGCTGTTCCAAGAACCGTACAAATACGAGGAATACTACCGCG
AAAACAGAGACAGTATGCCCGAAAAGGAGAGAGCAATATTTGAGGCTGTTCTTCCGGTGTGCCGTTACTACGT
ACATCTGCGATACAGCCTTCTCCAAGTCCTTTACGACGCCATGTTCGAAAGCACAATTACCGGCATGCCCATC
GCAAGAGCCATGGTAAACGCACTCAGCCCAACTCGCACAACACCCCGTGCTGACAGCGTCTCAGGTCATTACA
GACGCCCTCGACGCGTCCCTCCTCACGGCCAACAGTGCCTACGCCTCCACCCAATACCTCGCCGGCCCCTCCC
TCCTTGTCGCGCCGTCCCTTTCGCCCTCCTCTAGCCGCGACGTCTACCTCCCCACGACATCCTCCTGGTACCC
GCTCAACCTCCGCCCATGCACGACCGCGTCCTCCTCCCTCGGCGGCGTCCCGCTCCTGCCCGCCGTCGCGGGC
GGCACGCACCTGACTTACGACTGCCGCATCAGCGCGCTGCCCACCCAACTGCCCTACGCCTGCCCGACGTACG
TCCGCTCGGGCGCCATCATCCCGCAGATCCTCGTGCGCGCCAGCACACCCGACCGCACCTTCGCGCCGGCCTC
GTCTTCTCCCCCGTCGTCCGTGCCCTCGCTGCAACACCAGCCCCCTAACCCCATCACCATCCACGTCTACCCC
GGCCCCCCGAATGGCGAGAAGGGCTACACCTACCACATGTACCTCGACGATGGCGTGTCGCGCGCCAGTGCGC
CCGGGGCGGCGTACTTCGCCACGCTGCCGGTGCCGGTCGAGGAGGATGCAGTCGCGGTGGGCGGATTGGGTAG
GGTGAGCGCGGCGTATGGGGATAAGGAGGCTGGGAGCGAGTTTCGGCGGGTCGATGTTACGCAATGGATAAGC
GCGGCGGGAGAGGATGGGGATGCGGTGGGGAGGAGGAGGAGGAGGATTGAGGTGGGGACGGGGTGGGATGGGT
ATGGGGATGAGAGGGTGAGGAGGGATGTTGGAGATGAGTATAAGGTCGTGGTTTGGCATGAGGAGGGACGGT
GATGGGCGAGGTGAGCGTGCAGGTGGAAGCGGGGGGTTGTGAGGCGGGCAGGAGAGAGAGGGATGAGGGTGCG
AGGGCGGATGTCGTGTGGGTGCCGGTGGATAAGGAGGTGAAGACGACGATTGTGGTGACTTATGGTGGGAGTG
GTTGAGGGGGGTGTGGGGCATTGATGATGAGGGGGATCGGAACCTCTGTGAATCGAGATGCTGGCCTGAGGC
AACTATCAGGTGAGCTCACATTGCTGTATAGAAGGCTCAGACCCAAAGGCCATTTTCTGTCAGTGATTAGCGG
CTTGTGATT
```

SEQ ID NO: 167
LENGTH: 3363
TYPE: DNA
ORGANISM: M. phaseolina
FEATURE NAME/KEY: CDS
LOCATION: (1)...(3363)

```
atgccttgggccggccaagacaaaacttacacttccagcgacgagacgcatccgaagcac
 M  P  W  A  G  Q  D  K  T  Y  T  S  S  D  E  T  H  P  K  H cgcgacccattccggtttatccccgcggacgacttctacgagttcttttctggaaagcac
 R  D  P  F  R  F  I  P  A  D  D  F  Y  E  F  F  S  G  K  H cgcccaacatcagttacatgcaagccagaagatcaagccgtcgaggacaagacgaggaat
 R  P  T  S  V  T  C  K  P  E  D  Q  A  V  E  D  K  T  R  N gcggcatgccacaatggcaggatcttccgctttaacgatgacacacttatgctcattcaa
 A  A  C  H  N  G  R  I  F  R  F  N  D  D  T  L  M  L  I  Q ttcatccggcctcttgtttggagaatccagtttgatccgaatcgccaaaaagggtcggag
 F  I  R  P  L  V  W  R  I  Q  F  D  P  N  R  Q  K  G  S  E tacacggactggaatacaaagtcattactggagggaagattgtccaaaatgacgcgcgtt
 Y  T  D  W  N  T  K  S  L  L  E  G  R  L  S  K  M  T  R  V ctcgacactgcagaagagatagtctgggatgtcgagtttgaccctactcacgtcacgcat
 L  D  T  A  E  E  I  V  W  D  V  E  F  D  P  T  H  V  T  H ttcatccttcgctcgatcattgtctccagagggaagcgagttccgttgttgagttatgg
 F  I  L  R  S  I  I  V  S  R  G  K  R  V  P  V  V  E  L  W attcagcgaaatccatttagaataccgctattcggcggatcaaaacccggttgacgccg
 I  Q  R  N  P  F  R  I  T  A  I  R  R  I  K  T  R  L  T  P gaagtttctccttatggtgacatctcagttgatattccgggccctggaagagccatcatc
 E  V  S  P  Y  G  D  I  S  V  D  I  P  G  P  G  R  A  I  I tggcagacaacggagaaccccctacggcacgacgggcgggctacaatactctcagtcgag
 W  Q  T  T  E  N  P  L  R  H  D  G  R  A  T  I  L  S  V  E aagaaaccgcaggcaaagtacatgggctttggtggccaaggcggaaaaaacttgttcaaa
 K  K  P  Q  A  K  Y  M  G  F  G  G  Q  G  G  K  N  L  F  K gataacacttacctgaactacttcaatttcgataacatgcggtacaacaatatctacgct
 D  N  T  Y  L  N  Y  F  N  F  D  N  M  R  Y  N  N  I  Y  A aaggggcctgaagaggccgcagaaccattgtaccattcggagcccttttggatcgaaatc
 K  G  P  E  E  A  A  E  P  L  Y  H  S  E  P  F  W  I  E  I aacaggcatccaagctacatgtcccaggtggcaactttcatcgacaatttctcccaagtc
 N  R  H  P  S  Y  M  S  Q  V  A  T  F  I  D  N  F  S  Q  V tgccttgatgtcggcaagactgacaggagctccttccgcattgcaaccagattcaacagc
 C  L  D  V  G  K  T  D  R  S  S  F  R  I  A  T  R  F  N  S ttccaagctatttcatggccggtaacaccattgcggagatcatcagattgtatacttcc
 F  Q  A  I  F  M  A  G  N  T  I  A  E  I  I  R  L  Y  T  S ctgatcggcaaaccaaggctgatgcctcgatacgtccttggaaatcaccaaggctgctat
 L  I  G  K  P  R  L  M  P  R  Y  V  L  G  N  H  Q  G  C  Y ggatatgaccgtcaatggaaggttgaagaggtggtacgaaaataccgcgagtatgatatt
 G  Y  D  R  Q  W  K  V  E  E  V  V  R  K  Y  R  E  Y  D  I ccgctggacgggatgcacatcgacgttgacatgcagagaggataccgcacatttacaatt
 P  L  D  G  M  H  I  D  V  D  M  Q  R  G  Y  R  T  F  T  I gatagggacagatttcctgagccggagaagatgttccttgaattgcgtaagcaaggcgtg
 D  R  D  R  F  P  E  P  E  K  M  F  L  E  L  R  K  Q  G  V cgttgcagcaccaacatcacgcctgtcatcaactgcatacctgacacctcttacgtccct
 R  C  S  T  N  I  T  P  V  I  N  C  I  P  D  T  S  Y  V  P ctgaacgaaggcctggctgagaatcattttgttctggacaaaagggatatcgatccatca
 L  N  E  G  L  A  E  N  H  F  V  L  D  K  R  D  I  D  P  S gcgccaacttgccatgaccagaggtatatgcagtacggaaatgcggatctttactttaca
 A  P  T  C  H  D  Q  R  Y  M  Q  Y  G  N  A  D  L  Y  F  T aacccgaatgatgtggaccgcaggccttacccagatgaatacgactttgaggctcacttc
 N  P  N  D  V  D  R  R  P  Y  P  D  E  Y  D  F  E  A  H  F
```

```
-continued
aacaaatccgttccttccacgggggcgtctcctacggcgatgggcaaggtgcaccaggc
 N  K  S  V  P  F  H  G  G  V  S  Y  G  D  G  Q  G  A  P  G cattacccgaatctgaacaacaagcgcactcgagaatggtggggaaagcagtacaaagac
 H  Y  P  N  L  N  N  K  R  T  R  E  W  W  G  K  Q  Y  K  D ctcttcgacgcagggcttgagttcatctggcaggacatgacgtcccttgcataggtgat
 L  F  D  A  G  L  E  F  I  W  Q  D  M  T  S  P  C  I  G  D gcatacggagacatgaagtcgtggccgttccggcttctactcgagtctgacagctggcga
 A  Y  G  D  M  K  S  P  F  R  W  L  L  E  S  D  S  W  R ggagaacaacgccgcaggagactcagcattccggcacctgccgataaggaagagctcaag
 G  E  Q  R  R  R  R  L  S  I  P  A  P  A  D  K  E  E  L  K actgctatcgagctttggtcactgtatagcctcaacctacataaggcgacttttaaaggg
 T  A  I  E  L  W  S  L  Y  S  L  N  H  K  A  T  F  K  G ctcaagcggttggaaagccggaaggaaagcggaacttcatcattggaaggggcagtttc
 L  K  R  L  E  S  R  K  G  K  R  N  F  I  I  G  R  G  S  F gccggcgcccagcgctatgccggactctggactggcgataatgcatctacttgggagttc
 A  G  A  Q  R  Y  A  G  L  W  T  G  D  N  A  S  T  W  E  F ctcagtgtctcaatctcgcaggtcctttctcttggtcttcaggcatgacgatggctggc
 L  S  V  S  I  S  Q  V  L  S  L  G  L  S  G  M  T  M  A  G gctgatgttgggggttttgagcttgcgcttggagagtcgaagttcgccgatcctgagctt
 A  D  V  G  G  F  E  L  A  L  G  E  S  K  F  A  D  P  E  L ctgatccgctggtactgtgcgaacagcttacttccgtggtttagtgggaggcacgaacct
 L  I  R  W  Y  C  A  N  S  L  L  P  W  F  S  G  R  H  E  P ttcgaggatcgaccagatcagccgcgggattgtgacaagaagctgttccaagaaccgtac
 F  E  D  R  P  D  Q  P  R  D  C  D  K  K  L  F  Q  E  P  Y aaatacgaggaatactaccgcgaaaacagagacagtatgcccgaaaaggagagagcaata
 K  Y  E  E  Y  Y  R  E  N  R  D  S  M  P  E  K  E  R  A  I tttgaggctgttcttccggtgtgccgttactacgtacatctgcgatacagccttctccaa
 F  E  A  V  L  P  V  C  R  Y  Y  V  H  L  R  Y  S  L  L  Q gtcctttacgacgccatgttcgaaagcacaattaccggcatgcccatcgcaagagccatg
 V  L  Y  D  A  M  F  E  S  T  I  T  G  M  P  I  A  R  A  M gtcattacagacgccctcgacgcgtccctcctcacggccaacagtgcctacgcctccacc
 V  I  T  D  A  L  D  A  S  L  L  T  A  N  S  A  Y  A  S  T caatacctcgccggccctcccctccttgtcgcgccgtccctttcgccctcctctagccgc
 Q  Y  L  A  G  P  S  L  L  V  A  P  S  L  S  P  S  S  S  R gacgtctacctccccacgacatcctcctggtacccgctcaacctccgcccatgcacgacc
 D  V  Y  L  P  T  T  S  S  W  Y  P  L  N  L  R  P  C  T  T gcgtcctcctccctcggcggcgtcccgctcctgccggcgtcgcgggcggcacgcacctg
 A  S  S  S  L  G  G  V  P  L  L  P  A  V  A  G  G  T  H  L acttacgactgccgcatcagcgcgctgcccacccaactgccctacgcctgcccgacgtac
 T  Y  D  C  R  I  S  A  L  P  T  Q  L  P  Y  A  C  P  T  Y gtccgctcgggcgccatcatcccgcagatcctcgtgcgcgccagcacacccgaccgcacc
 V  R  S  G  A  I  I  P  Q  I  L  V  R  A  S  T  P  D  R  T ttcgcgccggcctcgtcttctccccgtcgtccgtgccctcgctgcaacaccagccccct
 F  A  P  A  S  S  S  P  P  S  S  V  P  S  L  Q  H  Q  P  P aaccccatcaccatccacgtctaccccggccccccgaatggcgagaagggctacacctac
 N  P  I  T  I  H  V  Y  P  G  P  P  N  G  E  K  G  Y  T  Y cacatgtacctcgacgatggcgtgtcgcgcgccagtgcgcccggggcggcgtacttcgcc
 H  M  Y  L  D  D  G  V  S  R  A  S  A  P  G  A  A  Y  F  A acgctgccggtgccggtcgaggaggatgcagtcgcggtgggcggattgggtagggtgagc
 T  L  P  V  P  V  E  E  D  A  V  A  V  G  G  L  G  R  V  S gcggcgtatggggataaggaggctgggagcgagtttcggcggtcgatgttacgcaatgg
 A  A  Y  G  D  K  E  A  G  S  E  F  R  R  V  D  V  T  Q  W ataagcgcggcgggagaggatggggatgcggtggggaggaggaggaggaggattgaggtg
 I  S  A  A  G  E  D  G  D  A  V  G  R  R  R  R  R  I  E  V
```

```
gggacggggtgggatgggtatggggatgagagggtgaggagggatgttggagatgagtat
 G  T  G  W  D  G  Y  G  D  E  R  V  R  R  D  V  G  D  E  Y aaggtcgtggtttggcatgaggaggggacggtgatgggcgaggtgagcgtgcaggtggaa
 K  V  V  V  W  H  E  E  G  T  V  M  G  E  V  S  V  Q  V  E gcgggggttgtgaggcgggcaggagagagagggatgaggggtgcgagggcggatgtcgtg
 A  G  G  C  E  A  G  R  R  E  R  D  E  G  A  R  A  D  V  V tgggtgccggtggataaggaggtgaagacgacgattgtggtgacttatggtgggagtggt
 W  V  P  V  D  K  E  V  K  T  T  I  V  V  T  Y  G  G  S  G tga
-
SEQ ID NO: 168
LENGTH: 1120
TYPE: PRT
ORGANISM: M. phaseolina
```

MPWAGQDKTYTSSDETHPKHRDPFRFIPADDFYEFFSGKHRPTSVTCKPEDQAVEDKTRNAACHNGRIFRFND

DTLMLIQFIRPLVWRIQFDPNRQKGSEYTDWNTKSLLEGRLSKMTRVLDTAEEIVWDVEFDPTHVTHFILRSI

IVSRGKRVPVVELWIQRNPFRITAIRRIKTRLTPEVSPYGDISVDIPGPGRAIIWQTTENPLRHDGRATILSV

EKKPQAKYMGFGGQGGKNLFKDNTYLNYFNFDNMRYNNIYAKGPEEAAEPLYHSEPFWIEINRHPSYMSQVAT

FIDNFSQVCLDVGKTDRSSFRIATRFNSFQAIFMAGNTIAEIIRLYTSLIGKPRLMPRYVLGNHQGCYGYDRQ

WKVEEVVRKYREYDIPLDGMHIDVDMQRGYRTFTIDRDRFPEPEKMFLELRKQGVRCSTNITPVINCIPDTSY

VPLNEGLAENHFVLDKRDIDPSAPTCHDQRYMQYGNADLYFTNPNDVDRRPYPDEYDFEAHFNKSVPFHGGVS

YGDGQGAPGHYPNLNNKRTREWWGKQYKDLFDAGLEFIWQDMTSPCIGDAYGDMKSWPFRLLLESDSWRGEQR

RRRLSIPAPADKEELKTAIELWSLYSLNLHKATFKGLKRLESRKGKRNFIIGRGSFAGAQRYAGLWTGDNAST

WEFLSVSISQVLSLGLSGMTMAGADVGGFELALGESKFADPELLIRWYCANSLLPWFSGRHEPFEDRPDQPRD

CDKKLFQEPYKYEEYYRENRDSMPEKERAIFEAVLPVCRYYVHLRYSLLQVLYDAMFESTITGMPIARAMVIT

DALDASLLTANSAYASTQYLAGPSLLVAPSLSPSSSRDVYLPTTSSWYPLNLRPCTTASSSLGGVPLLPAVAG

GTHLTYDCRISALPTQLPYACPTYVRSGAIIPQILVRASTPDRTFAPASSSPPSSVPSLQHQPPNPITIHVYP

GPPNGEKGYTYHMYLDDGVSRASAPGAAYFATLPVPVEEDAVAVGGLGRVSAAYGDKEAGSEFRRVDVTQWIS

AAGEDGDAVGRRRRRIEVGTGWDGYGDERVRRDVGDEYKVVVWHEEGTVMGEVSVQVEAGGCEAGRRERDEGA

RADVVWVPVDKEVKTTIVVTYGGSG*

```
SEQ ID NO: 169
LENGTH: 4339 (including 150 bp 5' UTR and 150 bp 3' UTR)
TYPE: DNA
ORGANISM: M. phaseolina
```
ACGGGCTACCGTCCATACTGTGGCCTTCTTTGCGACTCTTGTTCTGTCGAAGCCTGGCAGCTGTACTTCAGCG

CACGTTTTCTTCCCCGAAGCCCAGGGAAGTCCTGAGAATTCCTCGCACGAACCCATCAGACATTGAACCTGCC

CAATATGCCTGATGCCACGATCGGAACCCAGGATGAGAACCACCCCAAACATCGCGATCCATACCGCTTCATC

CCGGCAGATGAGTTCTTCGACAGAGAGCTCCTGACTGGCACTGTCAGGCCGGATTCTGTCACGTTCAGTGAGA

AGGATCAGCTCGATGCCACCGGGAAAAAGCTCAATCCGGCTTGCGGCCATGGCCGAGTGTTTCGACTTAGCAC

TGGCGCCGTCATGTTGATCCAGTTCATGCGTCCCTTGGTGTGGCGCATCAGATTCTATCCGCACTACAAGGAA

GGACATGATTTCACCGACTACAACACGTACGTCCACCGACCACTCTCTGCTCCGCGCAGCGGCACGACGCTTA

GGCTGACATTTCTGCAGGAGGACCATCATCAGGGGCAATTTGTCCAACATGATAGACATATTGGACCGCGCTG

AAGGCATCACATGGTCTGTGCAATTCGACGACAGCAACCCGCGCTACTACATTCTCAGATCCGTCGACGGAAA

CGGCAAGCCGGTAGTTCAGCTCTGGATTCAGCGCGACCCCTTCAGAATCATCGCCACCAGGACCATCAAGACC

CCCGGAAAGCTCAAGATGCATGTCCGCGACGATGAGGAAAGTCACCTTCCCATTACAGCCCCGGCGGAATCGG

GACAGGCCGTCATTTGGAAGACGAAGAAGAGGCCTCTGCAGTATCAAGTTCGTGGCTCGGACAAGGAGCCATG

TGCCATTGTGCTTTCTGTTGAGAAACCCGATCCTGCGAGGTTCATGGGCTTCGGCGAGCAGGGCGGCAAGGAT

CTGTTCAAGGATAACACTTTCATGAATTACTTCAGTAAGCAAGCCCGTGTCCAGGAGCTTACATATGGCGTGA

-continued

```
CAGCTAATCTCGTGCACAGACTTTGACAACATGCGGTACAATAACGTCTACGGGCGCGGCCCGTTTGAGGATG
CCGAGCCTCTGTACCACTCAGGCAAGACATCTCGACTCACATCAACGTGCTTTACACTGACTGTACATAGAAC
CCTACTTCATCGAAGTCAATGGCCATCCGGGATAGTGAGACGAGCCATTGATATACCTCTATTACTTGCCAGT
GCTAATGCATATGACAGCATGTCTCAATTGGCGACCTTCATCGACAACTACTCGCATGTTTGCGTGGATCTTG
GCAAAACCAATAcCACTCAGGTTCGCATTGCCACACGCTTCAATGGCTTCCAAGGCATCTTCATTGCCGGAAA
CGACATCAGCGAGGTGATCCGTCGCTACTCGTCGCTCATCGGGCGGCCAAGGCTGATGCCACGCTTCGTGCTT
GGCAACCACCAAGGCTGCTATGGATACGACCATCAGCAGAGAGTGGAGCAGGCGGTTCAGAAATATCGCGATT
ACGGCATCCCGCTTGGTATGACCTCTCAATTCCGCCATTGGGCGCGTGCTTACCTGAAACCCAGATGGCATGC
ATATCGATGTCGACATGCAACGTGACTACAGGACCTTCACCATCGACAAAGGGAAGTTCCCGGAGCCTGAGAA
GATGTTCTTGGAGTTGCGCAAGAAAGGCGTCCGCTGTAGCACCAACATCACTCCCGTCATCAATGCCAATAAT
GATGCGGATTACACCACGCTGAACGATGGCCTCGCCAACAACCACTTCGTGTTGGATCGGCGCAACATCGATC
CGTCTGCACCGAACTGGTTCGACCAACGTTACATGCAGTATGGCGGCTCGCAGATGTACTACACGCGTCCGTT
TGTGCCCAGCGATGCTGAAGAGCCTGATGACAATCATGACTTTAGCGCGTCTTTCAACAAAGCTGACCAGGGC
CAGCTTTTCCGTGGTGGCGTCTCCTATGGGAACAAGCAAGGCTGTCCTGGGTACTATCCTAATCTGAACCAAA
GAAGAACTCGAGACTGGTGGGGCAAGCAGTACGAGTACCTGTTCAACACTGGGCTTGAGTTCGTGTGGCAGGA
CATGACATCCCCCTGCATGGCTCAGCGATACGGAGACATGAAGTCGTAAGTTCCCAAGCCTATAAGTACACGG
CCTCGCAGCTGATCGGTATTACAGATGGCCGTTCCGTCTCATGCTTGACTCCGACGGTTGGCCTGGTGAGACC
AAAGCTCTGGTCAGAGACCCGGATCAGACCGATCAGAAGGCGGCCATCGAGATCTGGTCTCTGTACAGCTTTA
ACCTGCACAAGGCCACCTTCAAGGGTCTCAACCATCTCGACTGTCGCAAGGGCAAACGCAACTTCATCATCGG
CAGGGGTAGCTACGCCGGCGCTCAGCGCTACGCCGGCCTCTGGACCGGAGACAACGCTTCGACCTGGGACTTT
TTACAAATCTCCGTCGCCCAGGTCATCGCGCTCGGCTTGCAGGAGTGACGATTGCGGGCGCCGACGTGGGCG
GATTCGAGCCTCCCGAAGGAGACCTCACCGCGTTCGCTGACCCGGAACTGCTGATCCGCTGGTACTGCGCGTA
CAGTCTTCTCCCTTGGTTCAGGTCAGTTTGGGAACTCCCTAAATGCATAGCGATTCTAACTCTATTGCAGAAA
CCACTACAGCGCCAAGCATACTGGCAAGGAAAACATTGACTGGAAGAAGAAGGACTTTCAGGTGAGTGACATC
GGCGGTCCATGCATTACTCCGAGGCTAATCCGCACAAGGAGCCATATCGGTATGACGAATGGTACCGTGAACA
CTGGAGGGAGGTTATGGATGGAGAGCGCTATATCTACGAGTCGGTCTTGCCGGTCAGCAGATACTATATCCGC
CTCCGCTACAGCCTCTTGCAACTGCTGTATGATGCCATGTTCGAGAACAGCATCACAGGATTGCCCATTGCAA
GATCACTGGTCATCACTGATCCGCTGGATGGCAGTCTCTTCTCGAGGGTAAAAGACGTGAAAAAAATTCTTTC
CTGGCACCTAAGCTAACCGTTAACCAGCACGAATGGGCAAACAAGAGCCAATACATGGTCCGTAATGACATCC
TCGTGGCCCCGCAGCTGGAACAAAAGCGGGCGAGGCGCGAGATCTACTTCCCGTCCACCAACTCGTGGTTCCC
TTTGAACCTGCGTCCGCACTACGATGACGGCATCGGCGAGCCTTTGCAGCCCAGGGTCCAGGGCGGCGCCAAC
ATATcCTACGACTGCCACATTGCCGCGCAGGACGGCCAGCTTCCCTACGTCTGTCCGATGTACATCCGAGAAG
GTACTCTCCCCAAGTCCTGCCAACACGCAAACATTCACTCACACCCACCAGGTGCCATCATCCCCCAAATTCA
GGTCCGGGACTGCGTGCCCGACCGCACTCGGCCGGAGCTCCCGTCGGCGCCCGCCAACCCCATCACGATCAAC
ATCTACCCGGGCCACTCCTCGGTGAGTCTCATCAAAAGACGCTTCAGCAGCCCCGTCCGAGGCATCTATCTCT
TTACTTACAATTCTGTCCAGCGCGGCCCGAGCAAGTACTCCATGTACCTGGACGACGGCGTCTCGCGCAGCAG
CGCGCCCGATGACGCCTACCTGTTCTTGCAGCCGACAGACGCGGTGGACGAGGCGCAGGCGCGCCCGAACAAC
GAGTACGGCGACAAGGCGGCCCGCAGCAACTTCCGGCGCGTCGATATCGAGCAGGTAAGAACCAACAACCCCC
TCCCCTGGGTTGGGTGGGGGGCgGGGGCTTTCAGTGCGCCTGCGACGACGACTACTGACACGGAGTTCTCAGG
TAATCACCGACACGGACGACGCCAAGGTGACCCACAGGCGCATCAAGCTCTTTACGTACTGGAAGGGCAGCTT
GCTCGACCCCAAGGACGCGGAGAAGTATGACGATGCGCAGGTCAAGCGAGATGTCGGCGACGAGTACCGTCTC
```

-continued

```
GTTATCTGGCACGAGGCCGAAACCGACATGAGCAAGGTCTCTGTCAGCGTGGTGCGTGCTGGCACCAACGACG

ACCGGGTCAGGGTCATCAAGGACGTCGGAAAGAAGGCGTCCATGGTATGGGTGCCCACGGAGAAGCACGTCGA

GGCGGAAGTTGAGGTCAAGTATGAGTGAAAGTCGTCGTTTTCTTATAGTAGCTGCAGCTTCCGGCAAGCGGCA

GGCAGCCATTCTCATTAAGTGCAAGGGATCTGAATGATTTTATGGTGTGTCAGCGGGAGAATAATATGTTGGC

GTTATTGATTATTGCCAGAAATTGAGTCTATC
```

SEQ ID NO: 170
LENGTH: 3345
TYPE: DNA
ORGANISM: M. phaseolina
FEATURE NAME/KEY: CDS
LOCATION: (1)...(3345)

```
atgcctgatgccacgatcggaacccaggatgagaaccaccccaaacatcgcgatccatac
 M  P  D  A  T  I  G  T  Q  D  E  N  H  P  K  H  R  D  P  Y cgcttcatcccggcagatgagttcttcgacagagagctcctgactggcactgtcaggccg
 R  F  I  P  A  D  E  F  F  D  R  E  L  L  T  G  T  V  R  P gattctgtcacgttcagtgagaaggatcagctcgatgccaccgggaaaaagctcaatccg
 D  S  V  T  F  S  E  K  D  Q  L  D  A  T  G  K  K  L  N  P gcttgcggccatggccgagtgtttcgacttagcactggcgccgtcatgttgatccagttc
 A  C  G  H  G  R  V  F  R  L  S  T  G  A  V  M  L  I  Q  F atgcgtcccttggtgtggcgcatcagattctatccgcactacaaggaaggacatgatttc
 M  R  P  L  V  W  R  I  R  F  Y  P  H  Y  K  E  G  H  D  F accgactacaacacgaggaccatcatcaggggcaatttgtccaacatgatagacatattg
 T  D  Y  N  T  R  T  I  I  R  G  N  L  S  N  M  I  D  I  L gaccgcgctgaaggcatcacatggtctgtgcaattcgacgacagcaacccgcgctactac
 D  R  A  E  G  I  T  W  S  V  Q  F  D  D  S  N  P  R  Y  Y attctcagatccgtcgacggaaacggcaagccggtagttcagctctggattcagcgcgac
 I  L  R  S  V  D  G  N  G  K  P  V  V  Q  L  W  I  Q  R  D cccttcagaatcatcgccaccaggaccatcaagacccccggaaagctcaagatgcatgtc
 P  F  R  I  I  A  T  R  T  I  K  T  P  G  K  L  K  M  H  V cgcgacgatgaggaaagtcaccttcccattacagccccggcggaatcggacaggccgtc
 R  D  D  E  E  S  H  L  P  I  T  A  P  A  E  S  G  Q  A  V atttggaagacgaagaagaggcctctgcagtatcaagttcgtggctcggacaaggagcca
 I  W  K  T  K  K  R  P  L  Q  Y  Q  V  R  G  S  D  K  E  P tgtgccattgtgctttctgttgagaaacccgatcctgcgaggttcatgggcttcggcgag
 C  A  I  V  L  S  V  E  K  P  D  P  A  R  F  M  G  F  G  E cagggcggcaaggatctgttcaaggataacactttcatgaattacttcaactttgacaac
 Q  G  G  K  D  L  F  K  D  N  T  F  M  N  Y  F  N  F  D  N atgcggtacaataacgtctacgggcgcggcccgtttgaggatgccgagcctctgtaccac
 M  R  Y  N  N  V  Y  G  R  G  P  F  E  D  A  E  P  L  Y  H tcagaaccctacttcatcgaagtcaatggccatccgggatacatgtctcaattggcgacc
 S  E  P  Y  F  I  E  V  N  G  H  P  G  Y  M  S  Q  L  A  T ttcatcgacaactactcgcatgtttgcgtggatcttggcaaaaccaataccactcaggtt
 F  I  D  N  Y  S  H  V  C  V  D  L  G  K  T  N  T  T  Q  V cgcattgccacacgcttcaatggcttccaaggcatcttcattgccggaaacgacatcagc
 R  I  A  T  R  F  N  G  F  Q  G  I  F  I  A  G  N  D  I  S gaggtgatccgtcgctactcgtcgctcatcgggcggccaaggctgatgccacgcttcgtg
 E  V  I  R  R  Y  S  S  L  I  G  R  P  R  L  M  P  R  F  V cttggcaaccaccaaggctgctatggatacgaccatcagcagagagtggagcaggcggtt
 L  G  N  H  Q  G  C  Y  G  Y  D  H  Q  Q  R  V  E  Q  A  V cagaaatatcgcgattacggcatcccgcttgatggcatgcatatcgatgtcgacatgcaa
 Q  K  Y  R  D  Y  G  I  P  L  D  G  M  H  I  D  V  D  M  Q cgtgactacaggaccttcaccatcgacaaagggaagttcccggagcctgagaagatgttc
 R  D  Y  R  T  F  T  I  D  K  G  K  F  P  E  P  E  K  M  F ttggagttgcgcaagaaaggcgtccgctgtagcaccaacatcactcccgtcatcaatgcc
 L  E  L  R  K  K  G  V  R  C  S  T  N  I  T  P  V  I  N  A
```

```
aataatgatgcggattacaccacgctgaacgatggcctcgccaacaaccacttcgtgttg
 N  N  D  A  D  Y  T  T  L  N  D  G  L  A  N  N  H  F  V  L gatcggcgcaacatcgatccgtctgcaccgaactggttcgaccaacgttacatgcagtat
 D  R  R  N  I  D  P  S  A  P  N  W  F  D  Q  R  Y  M  Q  Y ggcggctcgcagatgtactacacgcgtccgtttgtgcccagcgatgctgaagagcctgat
 G  G  S  Q  M  Y  Y  T  R  P  F  V  P  S  D  A  E  E  P  D gacaatcatgactttagcgcgtctttcaacaaagctgaccagggccagcttttccgtggt
 D  N  H  D  F  S  A  S  F  N  K  A  D  Q  G  Q  L  F  R  G ggcgtctcctatgggaacaagcaaggctgtcctgggtactatcctaatctgaaccaaaga
 G  V  S  Y  G  N  K  Q  G  C  P  G  Y  Y  P  N  L  N  Q  R agaactcgagactggtggggcaagcagtacgagtacctgttcaacactgggcttgagttc
 R  T  R  D  W  G  K  Q  Y  E  Y  L  F  N  T  G  L  E  F gtgtggcaggacatgacatcccccctgcatggctcagcgatacggagacatgaagtcatgg
 V  W  Q  D  M  T  S  P  C  M  A  Q  R  Y  G  D  M  K  S  W ccgttccgtctcatgcttgactccgacggttggcctggtgagaccaaagctctggtcaga
 P  F  R  L  M  L  D  S  D  G  W  P  G  E  T  K  A  L  V  R gacccggatcagaccgatcagaaggcggccatcgagatctggtctctgtacagctttaac
 D  P  D  Q  T  D  Q  K  A  A  I  E  I  W  S  L  Y  S  F  N ctgcacaaggccaccttcaagggtctcaaccatctcgactgtcgcaagggcaaacgcaac
 L  H  K  A  T  F  K  G  L  N  H  L  D  C  R  K  G  K  R  N ttcatcatcggcaggggtagctacgcggcgctcagcgctacgccggcctctggaccgga
 F  I  I  G  R  G  S  Y  A  G  A  Q  R  Y  A  G  L  W  T  G gacaacgcttcgacctgggacttttacaaatctccgtcgcccaggtcatcgcgctcggc
 D  N  A  S  T  W  D  F  L  Q  I  S  V  A  Q  V  I  A  L  G ttggcaggagtgacgattgcgggcgccgacgtgggcggattcgagcctcccgaaggagac
 L  A  G  V  T  I  A  G  A  D  V  G  G  F  E  P  P  E  G  D ctcaccgcgttcgctgaccggaactgctgatccgctggtactgcgcgtacagtcttctc
 L  T  A  F  A  D  P  E  L  L  I  R  W  Y  C  A  Y  S  L  L ccttggttcagaaaccactacagcgccaagcatactggcaaggaaaacattgactggaag
 P  W  F  R  N  H  Y  S  A  K  H  T  G  K  E  N  I  D  W  K aagaaggactttcaggagccatatcggtatgacgaatggtaccgtgaacactggagggag
 K  K  D  F  Q  E  P  Y  R  Y  D  E  W  Y  R  E  H  W  R  E gttatggatggagagcgctatatctacgagtcggtcttgccggtcagcagatactatatc
 V  M  D  G  E  R  Y  I  Y  E  S  V  L  P  V  S  R  Y  Y  I cgcctccgctacagcctcttgcaactgctgtatgatgccatgttcgagaacagcatcaca
 R  L  R  Y  S  L  L  Q  L  L  Y  D  A  M  F  E  N  S  I  T ggattgcccattgcaagatcactggtcatcactgatccgctggatggcagtctcttctcg
 G  L  P  I  A  R  S  L  V  I  T  D  P  L  D  G  S  L  F  S aggcacgaatgggcaaacaagagccaatacatggtccgtaatgacatcctcgtggccccg
 R  H  E  W  A  N  K  S  Q  Y  M  V  R  N  D  I  L  V  A  P cagctggaacaaaagcgggcgaggcgcgagatctacttcccgtccaccaactcgtggttc
 Q  L  E  Q  K  R  A  R  R  E  I  Y  F  P  S  T  N  S  W  F cctttgaacctgcgtccgcactacgatgacggcatcggcgagcctttgcagcccagggtc
 P  L  N  L  R  P  H  Y  D  D  G  I  G  E  P  L  Q  P  R  V cagggcggcgccaacatatcctacgactgccacattgccgcgcaggacggccagcttccc
 Q  G  G  A  N  I  S  Y  D  C  H  I  A  A  Q  D  G  Q  L  P tacgtctgtccgatgtacatccgagaaggtgccatcatcccccaaattcaggtccgggac
 Y  V  C  P  M  Y  I  R  E  G  A  I  I  P  Q  I  Q  V  R  D tgcgtgcccgaccgcactcggccggagctcccgtcggcgcccgccaaccccatcacgatc
 C  V  P  D  R  T  R  P  E  L  P  S  A  P  A  N  P  I  T  I aacatctacccgggccactcctcgcgcggccccgagcaagtactccatgtacctggacgac
 N  I  Y  P  G  H  S  S  R  G  P  S  K  Y  S  M  Y  L  D  D ggcgtctcgcgcagcagcgcgcccgatgacgcctacctgttcttgcagccgacagacgcg
 G  V  S  R  S  S  A  P  D  D  A  Y  L  F  L  Q  P  T  D  A
```

-continued

```
gtggacgaggcgcaggcgcgcccgaacaacgagtacggcgacaaggcggcccgcagcaac
 V  D  E  A  Q  A  R  P  N  N  E  Y  G  D  K  A  A  R  S  N ttccggcgcgtcgatatcgagcaggtaatcaccgacacggacgacgccaaggtgacccac
 F  R  R  V  D  I  E  Q  V  I  T  D  T  D  D  A  K  V  T  H aggcgcatcaagctctttacgtactggaagggcagcttgctcgaccccaaggacgcggag
 R  R  I  K  L  F  T  Y  W  K  G  S  L  L  D  P  K  D  A  E aagtatgacgatgcgcaggtcaagcgagatgtcggcgacgagtaccgtctcgttatctgg
 K  Y  D  D  A  Q  V  K  R  D  V  G  D  E  Y  R  L  V  I  W cacgaggccgaaaccgacatgagcaaggtctctgtcagcgtggtgcgtgctggcaccaac
 H  E  A  E  T  D  M  S  K  V  S  V  S  V  V  R  A  G  T  N gacgaccgggtcagggtcatcaaggacgtcggaaagaaggcgtccatggtatgggtgccc
 D  D  R  V  R  V  I  K  D  V  G  K  K  A  S  M  V  W  V  P acggagaagcacgtcgaggcggaagttgaggtcaagtatgagtga
 T  E  K  H  V  E  A  E  V  E  V  K  Y  E  -
```

SEQ ID NO: 171
LENGTH: 1114
TYPE: PRT
ORGANISM: M. phaseolina
MPDATIGTQDENHPKHRDPYRFIPADEFFDRELLTGTVRPDSVTFSEKDQLDATGKKLNPACGHGRVFRLSTG

AVMLIQFMRPLVWRIRFYPHYKEGHDFTDYNTRTIIRGNLSNMIDILDRAEGITWSVQFDDSNPRYYILRSVD

GNGKPVVQLWIQRDPFRIIATRTIKTPGKLKMHVRDDEESHLPITAPAESGQAVIWKTKKRPLQYQVRGSDKE

PCAIVLSVEKPDPARFMGFGEQGGKDLFKDNTFMNYFNFDNMRYNNVYGRGPFEDAEPLYHSEPYFIEVNGHP

GYMSQLATFIDNYSHVCVDLGKTNTTQVRIATRFNGFQGIFIAGNDISEVIRRYSSLIGRPRLMPRFVLGNHQ

GCYGYDHQQRVEQAVQKYRDYGIPLDGMHIDVDMQRDYRTFTIDKGKFPEPEKMFLELRKKGVRCSTNITPVI

NANNDADYTTLNDGLANNHFVLDRRNIDPSAPNWFDQRYMQYGGSQMYYTRPFVPSDAEEPDDNHDFSASFNK

ADQGQLFRGGVSYGNKQGCPGYYPNLNQRRTRDWWGKQYEYLFNTGLEFVWQDMTSPCMAQRYGDMKSWPFRL

MLDSDGWPGETKALVRDPDQTDQKAAIEIWSLYSFNLHKATFKGLNHLDCRKGKRNFIIGRGSYAGAQRYAGL

WTGDNASTWDFLQISVAQVIALGLAGVTIAGADVGGFEPPEGDLTAFADPELLIRWYCAYSLLPWFRNHYSAK

HTGKENIDWKKKDFQEPYRYDEWYREHWREVMDGERYIYESVLPVSRYYIRLRYSLLQLLYDAMFENSITGLP

IARSLVITDPLDGSLFSRHEWANKSQYMVRNDILVAPQLEQKRARREIYFPSTNSWFPLNLRPHYDDGIGEPL

QPRVQGGANISYDCHIAAQDGQLPYVCPMYIREGAIIPQIQVRDCVPDRTRPELPSAPANPITINIYPGHSSR

GPSKYSMYLDDGVSRSSAPDDAYLFLQPTDAVDEAQARPNNEYGDKAARSNFRRVDIEQVITDTDDAKVTHRR

IKLFTYWKGSLLDPKDAEKYDDAQVKRDVGDEYRLVIWHEAETDMSKVSVSVVRAGTNDDRVRVIKDVGKKAS

MVWVPTEKHVEAEVEVKYE*

SEQ ID NO: 172
LENGTH: 2377 (including 150 bp 5' UTR and 150 bp 3' UTR)
TYPE: DNA
ORGANISM: M. phaseolina
CCACTGTGCTATAGAGATACTCGTGGACGTTTCGCGTCCTAATTGGCCCTCCGAATCGCTTCCTTTCCCATTC GGgAAGTCGAGCTCACGACACCCTCATCCAGCCAAGCCCATTTGCTCGGAATTCAGCCCTCCCACCAGCCCGC

CACCATGTTCTCCCAAGACGGCCACCGCCTCATCTACCGCTACGACGCCGAAACGCTCTGGATCGAGCCCTGG

GGCCCCAACGCCGTCCGCGTCCGCGCCACCAAATGCTCGCACATGCCGGCCGACAACTGGGCCCTCGACATCA

CGCCGCCCGCCCTCGCTGCCGCTCCGACAATCGCCATCCCCCGCGCCGGGAGCGGCAGCGCCAACGCCACCCT

CACCAACGGCGCCATCCGCGCGACGCTCACGCCCCGCGGCAAACTCACCCTGCACAACGCGCACACCCAGGCC

CTCCTCGTGGCCGAATACGCGCGCAACCGGCTCGACGTGACGGACCCGCAGTGCAGCGCGCTCGAGATCGCGG

CGCGCGACTTCGCGCCCGTCCCCGGCAGCGACGCGTACGCGCTGACGGCGCGGTTCGAGGGCGTCGCGCGCGG

CGAGAAGCTGTACGGCATGGGCCAGTACCAGCACGGGCTGCTCGACCTCGCCGGCGCCGACGTCGAGCTCGCC

CAGCGCAACTCGCAGGCCAGCGTGCCGTTCCTGGTCAGCAGCCGCGGGTACGGGCTGCTGTGGAACAATCCGG

-continued

```
GCGTGGGCCGGGCCGTGCTGGGCAAGAACGTGCGCAGCTTCGAGGCCGCGGCCACGCGCGCGCTGGACTACTG

GGTTGTTGCGGGCGACGGCGCGGGCCCCAAGGCGATCGAGCGCGCGTATGCGGGCGTGACGGGCAAGGCGCCG

ATGATGCCCGAGTACGGGCTGGGGTTCTGGCAGTGCAAGCTGCGGTACCAGACGCAGGAGGAGCTGCTGGGCG

TGGCGCGGGAGTACCGGAGGCGGGGGCTGCCGATTGATGTGATTGTGGTCGACTTCTTCCACTGGCCGAGGCA

GGGCGAGTGGAGGTTCGATCCGGTCTTTTGGCCGGATCCGGATGCGATGGTAAGGGAGTTGAAGGAGCTGCGG

ATTGAGCTGATGGTGTCCATCTGGCCGACGGTCGACAAGCGGTCGGAGCACTACGAGGAGATGGTCGAGCATG

GCTACCTCATCCGAACGGATCGCGGGATCCGGACGGCCATGGACTTCCAGGGCGATACCGTCCATGCCGACTT

CACCAATCCCGGGGCGCGCGAATACGTCTGGAAGCTGGTCAAGAAGAACTACTGGGACAAGGGCATCCGCATC

TTCTGGTGCGACGAGGCGGAGCGTAAGTTATGTCCTGTATTCACACAAACCCCCTCCCCCCcGCAACACCTCA

GCTCACCCCGCAGCCGAATACACCGTCTACGACTTCGACAACTACCGCTACCACGCCGGGCCCAACCTGCAGA

TCGGCAACCTCTACCCGCTGCACTACGCCGCCGCCTTCCACGCCGGCCAACACGCTGCCGGCCAAACGCAGAT

TGTCAACCTGCTCCGCTGCGCGTGGGCATCGTCCCAAAAATACGGCGCCCTTGTCTGGAGCGGCGACATCGCC

TCGTCCTGGCCGTCGCTGCGCGCGCAGCTGGCCGCCGGCCTGAACATGGGCCTCGCCGGCATCCCGTGGTGGA

CgACCGACATCGGCGGCTTCCACGGCGGCGATCCGCGCGACGCCGCCTTCAGGGAGCTGTTCGTGCGGTGGTT

CCAGTGGGGCGCCTTCTGTCCCGTCATGCGGCTGCACGGGGACCGCGAGCCGCGGCAGCCGAGGCTGGGCGAA

GGCGGCGGGAGCGGGTGCCGGAGCGGTGCGCCGAACGAGGTGTGGTCGTATGGCGAGGAGGTCTATGCCATTT

GCGAGAGGTACTTGCGGGTGCGCGAGGGGCTGAGGGCCTATACGCGCGAGGCCATGCGGGAAGCGCATGAGGA

GGGCGATCCGGTCATGAGGACGCTGTTTTATGAGTTCCCGGACGATGCCAGGGCGTGGGAGGTCGAGGACGAA

TACTTGTTCGGGCCGAAGTACCTGGTGGCGCCGGTGCTATATCCCGGCATCAAGACCCGGAAGGTGTACTTCC

CTAAGGGAGCGACCTGGAAAGCGTTCGAGGGGGATGCGAAGTACGAAGGAGGAACTACTGCGGAAGTGGACAC

GCCGATTGAGTCTATCCCGGTGTTCGTCAGGGAATAGCCAGAAAAAGATGGCTCTACTGACCACAGCCTGAG

AGCAACCGCGACGGAAACCAAGGCTTCGTCTTCGGGTGAAATGTTCGGAGGAGATAGACCAGCCTTTGAAATG

TGTATGGGGCAACAAAAAAACAAAAaCGAATCAAAGTCAT
```

```
SEQ ID NO: 173
LENGTH: 2025
TYPE: DNA
ORGANISM: M. phaseolina
FEATURE NAME/KEY: CDS
LOCATION: (1)...(2025)
atgttctcccaagacggccaccgcctcatctaccgctacgacgccgaaacgctctggatc
 M   F   S   Q   D   G   H   R   L   I   Y   R   Y   D   A   E   T   L   W   I gagccctggggccccaacgccgtccgcgtccgcgccaccaaatgctcgcacatgccggcc
 E   P   W   G   P   N   A   V   R   V   R   A   T   K   C   S   H   M   P   A gacaactgggccctcgacatcacgccgcccgccctcgctgccgctccgacaatcgccatc
 D   N   W   A   L   D   I   T   P   P   A   L   A   A   A   P   T   I   A   I ccccgcgccgggagcggcagcgccaacgccaccctcaccaacggcgccatccgcgcgacg
 P   R   A   G   S   G   S   A   N   A   T   L   T   N   G   A   I   R   A   T ctcacgccccgcggcaaactcacccctgcacaacgcgcacacccaggccctcctcgtggcc
 L   T   P   R   G   K   L   T   L   H   N   A   H   T   Q   A   L   L   V   A gaatacgcgcgcaaccggctcgacgtgacggaccccgcagtgcagcgcgctcgagatcgcg
 E   Y   A   R   N   R   L   D   V   T   D   P   Q   C   S   A   L   E   I   A gcgcgcgacttcgcgcccgtccccggcagcgacgcgtacgcgctgacggcgcggttcgag
 A   R   D   F   A   P   V   P   G   S   D   A   Y   A   L   T   A   R   F   E ggcgtcgcgcgcggcgagaagctgtacggcatgggccagtaccagcacgggctgctcgac
 G   V   A   R   G   E   K   L   Y   G   M   G   Q   Y   Q   H   G   L   L   D ctcgccggcgccgacgtcgagctcgcccagcgcaactcgcaggccagcgtgccgttcctg
 L   A   G   A   D   V   E   L   A   Q   R   N   S   Q   A   S   V   P   F   L gtcagcagccgcgggtacgggctgctgtggaacaatccgggcgtgggccgggccgtgctg
 V   S   S   R   G   Y   G   L   L   W   N   N   P   G   V   G   R   A   V   L
```

```
ggcaagaacgtgcgcagcttcgaggccgggccacgcgcgctggactactggttgtt
 G  K  N  V  R  S  F  E  A  A  A  T  R  A  L  D  Y  W  V  V gcgggcgacggcgcgggccccaaggcgatcgagcgcgcgtatgcgggcgtgacgggcaag
 A  G  D  G  A  G  P  K  A  I  E  R  A  Y  A  G  V  T  G  K gcgccgatgatgcccgagtacgggctgggggttctggcagtgcaagctgcggtaccagacg
 A  P  M  M  P  E  Y  G  L  G  F  W  Q  C  K  L  R  Y  Q  T caggaggagctgctgggcgtggcgcgggagtaccggaggcggggctgccgattgatgtg
 Q  E  E  L  L  G  V  A  R  E  Y  R  R  R  G  L  P  I  D  V attgtggtcgacttcttccactggccgaggcagggcgagtggaggttcgatccggtcttt
 I  V  V  D  F  F  H  W  P  R  Q  G  E  W  R  F  D  P  V  F tggccggatccggatgcgatggtaagggagttgaaggagctgcggattgagctgatggtg
 W  P  D  P  D  A  M  V  R  E  L  K  E  L  R  I  E  L  M  V tccatctggccgacggtcgacaagcggtcggagcactacgaggagatggtcgagcatggc
 S  I  W  P  T  V  D  K  R  S  E  H  Y  E  E  M  V  E  H  G tacctcatccgaacggatcgcggatccggacggccatggacttccagggcgataccgtc
 Y  L  I  R  T  D  R  G  I  R  T  A  M  D  F  Q  G  D  T  V catgccgacttcaccaatcccggggcgcgcgaatacgtctggaagctggtcaagaagaac
 H  A  D  F  T  N  P  G  A  R  E  Y  V  W  K  L  V  K  K  N tactgggacaagggcatccgcatcttctggtgcgacgaggcggagcctcaccccgcagcc
 Y  W  D  K  G  I  R  I  F  W  C  D  E  A  E  P  H  P  A  A gaatacaccgtctacgacttcgacaactaccgctaccacgccgggcccaacctgcagatc
 E  Y  T  V  Y  D  F  D  N  Y  R  Y  H  A  G  P  N  L  Q  I ggcaacctctacccgctgcactacgccgccgccttccacgccggccaacacgctgccggc
 G  N  L  Y  P  L  H  Y  A  A  A  F  H  A  G  Q  H  A  A  G caaacgcagattgtcaacctgctccgctgcgcgtgggcatcgtcccaaaaatacggcgcc
 Q  T  Q  I  V  N  L  L  R  C  A  W  A  S  S  Q  K  Y  G  A cttgtctggagcggcgacatcgcctcgtcctggccgtcgctgcgcgcgcagctggccgcc
 L  V  W  S  G  D  I  A  S  S  W  P  S  L  R  A  Q  L  A  A ggcctgaacatgggcctcgccggcatcccgtggtggacgaccgacatcggcggcttccac
 G  L  N  M  G  L  A  G  I  P  W  W  T  T  D  I  G  G  F  H ggcggcgatccgcgcgacgccgccttcagggagctgttcgtgcggtggttccagtggggc
 G  G  D  P  R  D  A  A  F  R  E  L  F  V  R  W  F  Q  W  G gccttctgtcccgtcatgcggctgcacggggaccgcgagccgcggcagccgaggctgggc
 A  F  C  P  V  M  R  L  H  G  D  R  E  P  R  Q  P  R  L  G gaaggcggcgggagcgggtgccggagcggtgcgccgaacgaggtgtggtcgtatggcgag
 E  G  G  G  S  G  C  R  S  G  A  P  N  E  V  W  S  Y  G  E gaggtctatgccatttgcgagaggtacttgcgggtgcgcgaggggctgagggcctatacg
 E  V  Y  A  I  C  E  R  Y  L  R  V  R  E  G  L  R  A  Y  T cgcgaggccatgcgggaagcgcatgaggagggcgatccggtcatgaggacgctgttttat
 R  E  A  M  R  E  A  H  E  E  G  D  P  V  M  R  T  L  F  Y gagttccccggacgatgccaggcgtgggaggtcgaggacgaatacttgttcgggccgaag
 E  F  P  D  D  A  R  A  W  E  V  E  D  E  Y  L  F  G  P  K tacctggtggcgccggtgctatatcccggcatcaagacccggaaggtgtacttccctaag
 Y  L  V  A  P  V  L  Y  P  G  I  K  T  R  K  V  Y  F  P  K ggagcgacctggaaagcgttcgagggggatgcgaagtacgaaggaggaactactgcggaa
 G  A  T  W  K  A  F  E  G  D  A  K  Y  E  G  G  T  T  A  E gtggacacgccgattgagtctatcccggtgttcgtcagggaatag
 V  D  T  P  I  E  S  I  P  V  F  V  R  E  -

SEQ ID NO: 174
LENGTH: 674
TYPE: PRT
ORGANISM: M. phaseolina
MFSQDGHRLIYRYDAETLWIEPWGPNAVRVRATKCSHMPADNWALDITPPALAAAPTIAIPRAGSGSANATLT

NGAIRATLTPRGKLTLHNAHTQALLVAEYARNRLDVTDPQCSALEIAARDFAPVPGSDAYALTARFEGVARGE

KLYGMGQYQHGLLDLAGADVELAQRNSQASVPFLVSSRGYGLLWNNPGVGRAVLGKNVRSFEAAATRALDYWV
```

-continued

VAGDGAGPKAIERAYAGVTGKAPMMPEYGLGFWQCKLRYQTQEELLGVAREYRRRGLPIDVIVVDFFHWPRQG

EWRFDPVFWPDPDAMVRELKELRIELMVSIWPTVDKRSEHYEEMVEHGYLIRTDRGIRTAMDFQGDTVHADFT

NPGAREYVWKLVKKNYWDKGIRIFWCDEAEPHPAAEYTVYDFDNYRYHAGPNLQIGNLYPLHYAAAFHAGQHA

AGQTQIVNLLRCAWASSQKYGALVWSGDIASSWPSLRAQLAAGLNMGLAGIPWWTTDIGGFHGGDPRDAAFRE

LFVRWFQWGAFCPVMRLHGDREPRQPRLGEGGGSGCRSGAPNEVWSYGEEVYAICERYLRVREGLRAYTREAM

REAHEEGDPVMRTLFYEFPDDARAWEVEDEYLFGPKYLVAPVLYPGIKTRKVYFPKGATWKAFEGDAKYEGGT

TAEVDTPIESIPVFVRE*

SEQ ID NO: 175
LENGTH: 2732 (including 150 bp 5' UTR and 150 bp 3' UTR)
TYPE: DNA
ORGANISM: M. phaseolina

CCGTCTCTGCTTGCAATCCCCTGCTATTCAACGGCGTGTCGTTTCCTTAAGCTACGGGTCTGAGCTGGCGGAA

CCCAGGGCACTTCATGCAATTTAAAACATCATTACCGCCTTTGCCGGCAACTAGCGGAGTCCTGACGACGTCC

AGGCATGTGGCTCGTCGCGGCCGACAAACATGTGCAGTATGCGGAGGACATCTACACCGTCACACCCAGGGAT

GACAAGGCTCTCGACCTCCTGTGTCCTACGAGGCACATCCGGTCCCGCGGCGATACGCTAAATCTGAGCACCA

TCAATGTCGAGCTCGAGGCACAGTTTGACGGGGTCATCTCTATTGAGGCTACCCACTTCTCTGGAGCTCAAAG

AAGGGGGCCGAACTTCGAGCTGTTCCCGGATGGAAGGCCAGAGCGCGGGAAGAGTGAGTGGGTACGAACTCGC

CTCACTTGCAGTTTCTGACGAGATTCCAGCCGGTATAAGCAAAGGAGAGAAGGGAACCACACTCACATCAGGA

GCACTCTCCGCCACGGTCGGGCCGGACCCGCATGCCTTTGACATCCGCTTCCACGCGACGGACGGGTCGAAGG

AGCTCACGCAGCTGCTGAACCGCAGCGTTGGTCTTGCGTACAGCCCCGCCACCAGCAACCCGAAGCAGGTGGA

GGACATGCGCAACCTGCAGCATTACGTCTTCACGCAGCACGAGCTCGGGGTGGGCGAGACGATCCATGGCTG

GGCGAGCGGTTCGGAGCGTGGAACAAGGTAGGCCAGACGGTGGAGCTCTGGAACGAGGACGGCGGGACGTCGA

GCGACCAGGCGTACAAGAACATCTCCTTCTACCTGAGCTCCAAGGGCTACGGCGTCTTCATCGACACGCCGGA

CAGGGTGTCGCTCGAGATTGGCAGCGAGCGGTGCTGCCGGCTGCAGGCGTCGGTCGAGGGCCAACGGCTCAAG

TGGTACATCATCTACGGGCAGTCGGGCCCCAAGGAGGTGCTGAGCAAGTACTCGATGCTGACGGGGCGGCCGG

GGAAGCTGCCGGCATGGAGCTTCGGGCTGTGGCTGTCGACGTCGTTCACGACCGACTACGACGAGCGGACGGT

GACGCACTTCCTGGAGGAGATGCGGGCGCGGTCGGTGCCGGTCGAGACATTCCACTTCGACTGCTTCTGGCTG

CGGGCCTTCCACTGGTGCGACTTTGTGTTCTCGTCGGAGCACTTCCCGGATGCGGCGGGCCAGATCAGGCGGA

TGAAGGAGGCGGGCTGGCGAACAAGGTGTGCGTGTGGATCAACCCGTACCTGGGCCAGGCGTCGCCCGTGTT

CCGGTACGCGGCGGAGCGGGGCTATCTGCTGAAGCGCAAGAACGGCGATGTGTGGCAGTGGGACCTGTGGCAG

ACGGGCATGGGCATCGTCGACATCACCAACCCGGCGGCGCGCGACTGGTACGTGGGCTGTCTGAAGCAGCTGT

TCGACCTGGGCGTCGACACGCTGAAGACCGACTTTGGCGAGCGCATTCCCGTCACCGACGTGCAGTGGCACGA

CCGCGACGTCGACCCAGCCCGCATGCACAACTACTACGCCTTCTGGTATAACAAGCTCGTCTACGAGGCACTG

GAGCACCGCTACGGCAGCGGCGAAGCCGTGTTGTTCGCGCGGGCCGCCACCGCCGGCACCCAGCGCTTCCCCC

TGGTAAGCTGGCCCTTTTCCTGACCACTCCCGCGTCTGATCCTTCGCCCTGCTGACCCGCGCGCACCAGTGCT

GGGGCGGCGACTGCGAGTCCACGCCCGCCGCGCTGGCCGAGTCGGTCCGCGGCGGCCTGTCGCTCGGCCTGTC

GGGCTTCAGCTTCTGGTCCTGCGACATTGGCGGCTTCGAGGGCAACCCGCCGCCGTGGATCTACAAGCGCTGG

GTGGCCTTCGGTCTGCTGTGCTCGCACAGCCGCCTGCACGGCTCCAACTCCTACCGCGTGCCGTGGCTCATCG

ACGGCGGTGCGAGCGGCGAGGGCAGCGCGACCAGCGTGCTGCGCACCTTTGTGCGCCTCAAGCGCCGCCTGAT

GCCCTACCTGTACGCCCAGGCAGAGACCAGCCGCCGCAACGGCTGGCCGCTGTCGCTGCGCGCCATGTGCCTC

GAGTTCCCCGACGACCCGACCAGCTGGTTCCTCGACAGGCAGTTCATGGTCGGCGACAGCATCCTCGCCGCCC

CCGTCTTCACCGAGCACGGCGACGTCGACTTCTACCTGCCCGCCGGCCGCTGGACCTCGTGGTGGGATCCCAG

CGCCGTCATCGACGGCCCTGGCTGGCGTCGCGAGAAACACGGCTTTGAGACGCTGCCGCTGTACGTGCGCGAG

-continued

GGCGCCGTGCTTGTCCTGGGCCAGGAAGAGGAGGGAGTCAAGGGCGAGGGCTTCGCGTACGACTGGCTGCGCC

GCGGAGTCGACGTCCGTTTGTACCACACCAAGGGCGGCGAGTCGGCAGATGTCGTCGATGTCCAGGGCGAGTC

CGTTGCAACGCTGACGGTCGCGGACGGCGGCGCGGACGTCGTCGATGCCGGCCTGCAGAAGTTGCGGGCCAGA

GGCGGCGTCGACGTCCGCTGCGTGTAACTGTGCTTTTGCTTTATTGTTGCCCTTCCTTTCAGCTCTGACATTA

GCATGCAAGGGCTATTGCTCCGCAGCATTACAATAAACTAGCTGACTGACTGAATCAGCATGGCGCGTGGCTG

AACTCGTGTTTGTGAATGATGAGCGGTCGCA

SEQ ID NO: 176
LENGTH: 2316
TYPE: DNA
ORGANISM: *M. phaseolina*
FEATURE NAME/KEY: CDS
LOCATION: (1)...(2316)

atgtggctcgtcgcggccgacaaacatgtgcagtatgcggaggacatctacaccgtcaca
 M  W  L  V  A  A  D  K  H  V  Q  Y  A  E  D  I  Y  T  V  T cccagggatgacaaggctctcgacctcctgtgtcctacgaggcacatccggtcccgcggc
 P  R  D  D  K  A  L  D  L  L  C  P  T  R  H  I  R  S  R  G gatacgctaaatctgagcaccatcaatgtcgagctcgaggcacagtttgacggggtcatc
 D  T  L  N  L  S  T  I  N  V  E  L  E  A  Q  F  D  G  V  I tctattgaggctacccacttctctggagctcaaagaaggggggccgaacttcgagctgttc
 S  I  E  A  T  H  F  S  G  A  Q  R  R  G  P  N  F  E  L  F ccggatggaaggccagagcgcgggaagaccggtataagcaaaggagagaagggaaccaca
 P  D  G  R  P  E  R  G  K  T  G  I  S  K  G  E  K  G  T  T ctcacatcaggagcactctccgccacggtcgggccggacccgcatgcctttgacatccgc
 L  T  S  G  A  L  S  A  T  V  G  P  D  P  H  A  F  D  I  R ttccacgcgacggacgggtcgaaggagctcacgcagctgctgaaccgcagcgttggtctt
 F  H  A  T  D  G  S  K  E  L  T  Q  L  L  N  R  S  V  G  L gcgtacagccccgccaccagcaacccgaagcaggtggaggacatgcgcaacctgcagcat
 A  Y  S  P  A  T  S  N  P  K  Q  V  E  D  M  R  N  L  Q  H tacgtcttcacgcagcacgagctcggggtgggcgagacgatccatgggctgggcgagcgg
 Y  V  F  T  Q  H  E  L  G  V  G  E  T  I  H  G  L  G  E  R ttcggagcgtggaacaaggtaggccagacggtggagctctggaacgaggacggcgggacg
 F  G  A  W  N  K  V  G  Q  T  V  E  L  W  N  E  D  G  G  T tcgagcgaccaggcgtacaagaacatctccttctacctgagctccaagggctacggcgtc
 S  S  D  Q  A  Y  K  N  I  S  F  Y  L  S  S  K  G  Y  G  V ttcatcgacacgccggacagggtgtcgctcgagattggcagcgagcggtgctgccggctg
 F  I  D  T  P  D  R  V  S  L  E  I  G  S  E  R  C  C  R  L caggcgtcggtcgagggccaacggctcaagtggtacatcatctacgggcagtcgggcccc
 Q  A  S  V  E  G  Q  R  L  K  W  Y  I  I  Y  G  Q  S  G  P aaggaggtgctgagcaagtactcgatgctgacggggcggccggggaagctgccggcatgg
 K  E  V  L  S  K  Y  S  M  L  T  G  R  P  G  K  L  P  A  W agcttcgggctgtggctgtcgacgtcgttcacgaccgactacgacgagcggacggtgacg
 S  F  G  L  W  L  S  T  S  F  T  T  D  Y  D  E  R  T  V  T cacttcctggaggagatgcgggcgcggtcggtgccggtcgagacattccacttcgactgc
 H  F  L  E  E  M  R  A  R  S  V  P  V  E  T  F  H  F  D  C ttctggctgcgggccttccactggtgcgactttgtgttctcgtcggagcacttcccggat
 F  W  L  R  A  F  H  W  C  D  F  V  F  S  S  E  H  F  P  D gcggcgggccagatcaggcggatgaaggagggcgggctggcgaacaaggtgtgcgtgtgg
 A  A  G  Q  I  R  R  M  K  E  G  G  L  A  N  K  V  C  V  W atcaacccgtacctgggccaggcgtcgcccgtgttccggtacgcggcggagcggggctat
 I  N  P  Y  L  G  Q  A  S  P  V  F  R  Y  A  A  E  R  G  Y ctgctgaagcgcaagaacggcgatgtgtggcagtgggacctgtggcagacgggcatgggc
 L  L  K  R  K  N  G  D  V  W  Q  W  D  L  W  Q  T  G  M  G atcgtcgacatcaccaacccggcggcgcgcgactggtacgtgggctgtctgaagcagctg
 I  V  D  I  T  N  P  A  A  R  D  W  Y  V  G  C  L  K  Q  L

```
ttcgacctgggcgtcgacacgctgaagaccgactttggcgagcgcattcccgtcaccgac
 F  D  L  G  V  D  T  L  K  T  D  F  G  E  R  I  P  V  T  D gtgcagtggcacgaccgcgacgtcgacccagcccgcatgcacaactactacgccttctgg
 V  Q  W  H  D  R  D  V  D  P  A  R  M  H  N  Y  Y  A  F  W tataacaagctcgtctacgaggcactggagcaccgctacggcagcggcgaagccgtgttg
 Y  N  K  L  V  Y  E  A  L  E  H  R  Y  G  S  G  E  A  V  L ttcgcgcgggccgccaccgccggcacccagcgcttccccctgtgctggggcggcgactgc
 F  A  R  A  A  T  A  G  T  Q  R  F  P  L  C  W  G  G  D  C gagtccacgcccgccgcgctggccgagtcggtccgcggcggcctgtcgctcggcctgtcg
 E  S  T  P  A  A  L  A  E  S  V  R  G  G  L  S  L  G  L  S ggcttcagcttctggtcctgcgacattggcggcttcgagggcaacccgccgccgtggatc
 G  F  S  F  W  S  C  D  I  G  G  F  E  G  N  P  P  P  W  I tacaagcgctgggtggccttcggtctgctgtgctcgcacagccgcctgcacggctccaac
 Y  K  R  W  V  A  F  G  L  L  C  S  H  S  R  L  H  G  S  N tcctaccgcgtgccgtggctcatcgacggcggtgcgagcggcgagggcagcgcgaccagc
 S  Y  R  V  P  W  L  I  D  G  G  A  S  G  E  G  S  A  T  S gtgctgcgcacctttgtgcgcctcaagcgccgcctgatgccctacctgtacgcccaggca
 V  L  R  T  F  V  R  L  K  R  R  L  M  P  Y  L  Y  A  Q  A gagaccagccgccgcaacggctggccgctgtcgctgcgcgccatgtgcctcgagttcccc
 E  T  S  R  R  N  G  W  P  L  S  L  R  A  M  C  L  E  F  P gacgacccgaccagctggttcctcgacaggcagttcatggtcggcgacagcatcctcgcc
 D  D  P  T  S  W  F  L  D  R  Q  F  M  V  G  D  S  I  L  A gcccccgtcttcaccgagcacggcgacgtcgacttctacctgcccgccggccgctggacc
 A  P  V  F  T  E  H  G  D  V  D  F  Y  L  P  A  G  R  W  T tcgtggtgggatcccagcgccgtcatcgacggccctggctggcgtcgcgagaaacacggc
 S  W  W  D  P  S  A  V  I  D  G  P  G  W  R  R  E  K  H  G tttgagacgctgccgctgtacgtgcgcgaggggcgccgtgcttgtcctgggccaggaagag
 F  E  T  L  P  L  Y  V  R  E  G  A  V  L  V  L  G  Q  E  E gagggagtcaagggcgagggcttcgcgtacgactggctgcgccgcggagtcgacgtccgt
 E  G  V  K  G  E  G  F  A  Y  D  W  L  R  R  G  V  D  V  R ttgtaccacaccaagggcggcgagtcggcagatgtcgtcgatgtccagggcgagtccgtt
 L  Y  H  T  K  G  G  E  S  A  D  V  V  D  V  Q  G  E  S  V gcaacgctgacggtcgcggacggcggcgcggacgtcgtcgatgccggcctgcagaagttg
 A  T  L  T  V  A  D  G  G  A  D  V  V  D  A  G  L  Q  K  L cgggccagaggcggcgtcgacgtccgctgcgtgtaa
 R  A  R  G  G  V  D  V  R  C  V  -

SEQ ID NO: 177
LENGTH: 771
TYPE: PRT
ORGANISM: M. phaseolina
MWLVAADKHVQYAEDIYTVTPRDDKALDLLCPTRHIRSRGDTLNLSTINVELEAQFDGVISIEATHFSGAQRR

GPNFELFPDGRPERGKTGISKGEKGTTLTSGALSATVGPDPHAFDIRFHATDGSKELTQLLNRSVGLAYSPAT

SNPKQVEDMRNLQHYVFTQHELGVGETIHGLGERFGAWNKVGQTVELWNEDGGTSSDQAYKNISFYLSSKGYG

VFIDTPDRVSLEIGSERCCRLQASVEGQRLKWYIIYGQSGPKEVLSKYSMLTGRPGKLPAWSFGLWLSTSFTT

DYDERTVTHFLEEMRARSVPVETFHFDCFWLRAFHWCDFVFSSEHFPDAAGQIRRMKEGGLANKVCVWINPYL

GQASPVFRYAAERGYLLKRKNGDVWQWDLWQTGMGIVDITNPAARDWYVGCLKQLFDLGVDTLKTDFGERIPV

TDVQWHDRDVDPARMHNYYAFWYNKLVYEALEHRYGSGEAVLFARAATAGTQRFPLCWGGDCESTPAALAESV

RGGLSLGLSGFSFWSCDIGGFEGNPPPWIYKRWVAFGLLCSHSRLHGSNSYRVPWLIDGGASGEGSATSVLRT

FVRLKRRLMPYLYAQAETSRRNGWPLSLRAMCLEFPDDPTSWFLDRQFMVGDSILAAPVFTEHGDVDFYLPAG

RWTSWWDPSAVIDGPGWRREKHGFETLPLYVREGAVLVLGQEEEGVKGEGFAYDWLRRGVDVRLYHTKGGESA

DVVDVQGESVATLTVADGGADVVDAGLQKLRARGGVDVRCV*
```

SEQ ID NO: 178
LENGTH: 1675 (including 150 bp 5' UTR and 150 bp 3' UTR)
TYPE: DNA
ORGANISM: M. phaseolina
TGCAACGATCACCAGCGGCCCCTGACCACCCCATAAAACAAATACAATAACAGCCCCGGAGGCGCGTCTCCGC

CGCCGCACTCCGAATTTCCCTGTTGCGTCGTTCCCATCGCACCCAGCCCAAAATCACCGCCTGTCCCCACGCC

CAACATGCGGCTGCCTAACTGTCTTCTAGCGCCTTCTTTACTTGGAGCTGCATGCTTGTTCGCTCAACAGGTC

GTGGCTTTCCCGAATGCCACGAAATACTCCACTTGGATGGCCGCCAGCATCATAAGTCGCGGGCAAGGAGTCC

TTACTGGCCAAGGCGATTCTTCCGAGCTACTTCAGGCAGGCTTCACCCAGAAGGCGTTCAGACAGTTGATCCA

ACAATACCCGAATGATCCCTCGGCCGGCCCGATTGATGAGTACATCCAGAAAAGCGTCAATTCTGTCATTACC

ACCGTGTCCAACGCCACGGCAGACACAGGCTATCCGCTCGACAGGCTCTCCAATGGCAACAACCTCATTGTCA

AGTATGAGGAAACTGGCAACGCGACTTATCAGGATGCCTTTGAGGCGTTGCGGCAATCTATCGATTTGCAGGC

GCGAAATGCGGAGGGAGGTCTGTTTTACTATGTTTACCCGTATTGGTCGTACTTGGACGGCATGTTTTCGCTC

GCGCCCTTTTACACGCTCTACACTAACCTGTACGATGCGGACAACACGACCGCCGTCATGGACGATGTAATCC

TTCAACTAGACTTGTTGTGGCAGCACTGCCGGAGTAATGCCACTGGCCTGCTCGTCCACGGCTATGACGCATC

GCGCACGGCCGTCTGGGCCGATCCTGTCACTGGCGCGAGCCCACATGTGTGGGGGAGAAGCTTGGGATGGTCT

GTATCTTCGATCGCTTTTGCGCTTCTGCACTAATTCGGGCGATAGGTACATGATGGCACTGATCGATACGCTC

GAACTGGTCCCCGAAACGGCGAAGGAGGCGCAGCAGTACCTTCAGACGCGGTTCAGGGAGCTCGCAGATGCGG

TGGTGCGCACAGTCGACAGAACCAGCGGTGCGTGGTGGCAGCTGCTGGACCAGCCCGGCCGCGAGGGTAACTA

CATCGAGAGCAGCGGCAGCGCCATGTTCGCCTATTCCTTGCTCAAAGGCGCGAGGCTGGGGTATCTGGAGGAC

GGACCCAGGAGCAACACGAGCGGAACCGCAGCGTGGACGGATGTGGCAACCCGAGCGTTCGAGTACGTGGTAG

ACAAGTTCGTGGTCCGCAATGTAAATGGCACGCTTGGGTACAATGGGACCGTTTCCGTTTGTAGCCTGAATTC

GACCGCTTCGTACGAGGTACGTTCGCCGAACCACCCACAGAACTCCCTGACTCGAGTCCGTGACCTGGGCTTG

TGAAAACGTTACGCTGATGGACCTTCCTTGCAGTATTATGTTGGGCGACCGATCCTCTACAATAGCGTTCTCG

GAAGTGCTGCGTTCATCCTTGCGTCGCTGGAATACGAGAGTTTTGTGGGCGTACCAAAGGATTAGGACGGTGG

TGCGGAGAACGATGTCAAGGGTGTCTGACGCGTCACATCACGGAGTTGAACGTAATACGGGGTCCGAAGGGGT

CTGCTGTCTTCGTATTGTACGTCTTTCGGACTTGCCGTCTCAGAAAGGTCTTCCCCAACACCGCGTATG

SEQ ID NO: 179
LENGTH: 1236
TYPE: DNA
ORGANISM: M. phaseolina
FEATURE NAME/KEY: CDS
LOCATION: (1)...(1236)
atgcggctgcctaactgtcttctagcgccttctttacttggagctgcatgcttgttcgct
 M   R   L   P   N   C   L   L   A   P   S   L   L   G   A   A   C   L   F   A caacaggtcgtggctttccgaatgccacgaaatactccacttggatggccgccagcatc
 Q   Q   V   V   A   F   P   N   A   T   K   Y   S   T   W   M   A   A   S   I ataagtcgcgggcaaggagtccttactggccaaggcgattcttccgagctacttcaggca
 I   S   R   G   Q   G   V   L   T   G   Q   G   D   S   S   E   L   L   Q   A ggcttcacccagaaggcgttcagacagttgatccaacaatacccgaatgatccctcggcc
 G   F   T   Q   K   A   F   R   Q   L   I   Q   Q   Y   P   N   D   P   S   A ggcccgattgatgagtacatccagaaaagcgtcaattctgtcattaccaccgtgtccaac
 G   P   I   D   E   Y   I   Q   K   S   V   N   S   V   I   T   T   V   S   N gccacggcagacacaggctatccgctcgacaggctctccaatggcaacaacctcattgtc
 A   T   A   D   T   G   Y   P   L   D   R   L   S   N   G   N   N   L   I   V aagtatgaggaaactggcaacgcgacttatcaggatgcctttgaggcgttgcggcaatct
 K   Y   E   E   T   G   N   A   T   Y   Q   D   A   F   E   A   L   R   Q   S atcgatttgcaggcgcgaaatgcggagggaggtctgttttactatgtttacccgtattgg
 I   D   L   Q   A   R   N   A   E   G   G   L   F   Y   Y   V   Y   P   Y   W -continued

```
tcgtacttggacggcatgttttcgctcgcgccttttacacgctctacactaacctgtac
 S  Y  L  D  G  M  F  S  L  A  P  F  Y  T  L  Y  T  N  L  Y gatgcggacaacacgaccgccgtcatggacgatgtaatccttcaactagacttgttgtgg
 D  A  D  N  T  T  A  V  M  D  D  V  I  L  Q  L  D  L  L  W cagcactgccggagtaatgccactggcctgctcgtccacggctatgacgcatcgcgcacg
 Q  H  C  R  S  N  A  T  G  L  L  V  H  G  Y  D  A  S  R  T gccgtctgggccgatcctgtcactggcgcgagcccacatgtgtgggggagaagcttggga
 A  V  W  A  D  P  V  T  G  A  S  P  H  V  W  G  R  S  L  G tggtacatgatggcactgatcgatacgctcgaactggtccccgaaacggcgaaggaggcg
 W  Y  M  M  A  L  I  D  T  L  E  L  V  P  E  T  A  K  E  A cagcagtaccttcagacgcggttcagggagctcgcagatgcggtggtgcgcacagtcgac
 Q  Q  Y  L  Q  T  R  F  R  E  L  A  D  A  V  V  R  T  V  D agaaccagcggtgcgtggtggcagctgctggaccagcccggccgcgagggtaactacatc
 R  T  S  G  A  W  W  Q  L  L  D  Q  P  G  R  E  G  N  Y  I gagagcagcggcagcgccatgttcgcctattccttgctcaaaggcgcgaggctggggtat
 E  S  S  G  S  A  M  F  A  Y  S  L  L  K  G  A  R  L  G  Y ctggaggacggacccaggagcaacacgagcggaaccgcagcgtggacggatgtggcaacc
 L  E  D  G  P  R  S  N  T  S  G  T  A  A  W  T  D  V  A  T cgagcgttcgagtacgtggtagacaagttcgtggtccgcaatgtaaatggcacgcttggg
 R  A  F  E  Y  V  V  D  K  F  V  V  R  N  V  N  G  T  L  G tacaatgggaccgtttccgtttgtagcctgaattcgaccgcttcgtacgagtattatgtt
 Y  N  G  T  V  S  V  C  S  L  N  S  T  A  S  Y  E  Y  Y  V gggcgaccgatcctctacaatagcgttctcggaagtgctgcgttcatccttgcgtcgctg
 G  R  P  I  L  Y  N  S  V  L  G  S  A  A  F  I  L  A  S  L gaatacgagagttttgtgggcgtaccaaaggattag
 E  Y  E  S  F  V  G  V  P  K  D  -

SEQ ID NO: 180
LENGTH: 411
TYPE: PRT
ORGANISM: M. phaseolina
MRLPNCLLAPSLLGAACLFAQQVVAFPNATKYSTWMAASIISRGQGVLTGQGDSSELLQAGFTQKAFRQLIQQ

YPNDPSAGPIDEYIQKSVNSVITTVSNATADTGYPLDRLSNGNNLIVKYEETGNATYQDAFEALRQSIDLQAR

NAEGGLFYYVYPYWSYLDGMFSLAPFYTLYTNLYDADNTTAVMDDVILQLDLLWQHCRSNATGLLVHGYDASR

TAVWADPVTGASPHVWGRSLGWYMMALIDTLELVPETAKEAQQYLQTRFRELADAVVRTVDRTSGAWWQLLDQ

PGREGNYIESSGSAMFAYSLLKGARLGYLEDGPRSNTSGTAAWTDVATRAFEYVVDKFVVRNVNGTLGYNGTV

SVCSLNSTASYEYYVGRPILYNSVLGSAAFILASLEYESFVGVPKD*

SEQ ID NO: 181
LENGTH: 1443 (including 150 bp 5' UTR and 150 bp 3' UTR)
TYPE: DNA
ORGANISM: M. phaseolina
GCGCTCCTAAACAGCCCCAGTAGCCCGCCGTCTGGTCTGGAGACGATAGTTAGCACGCCTGCTGTTGATTGAC

GCCAGTCGCGCCCTCACCACCCACCGGAGCCTCTCTGCCTCCCGCCTGCCCGGCCCCACCTCTCCCTCGCCCT

CACCATGCCCACCGCCCTCTCCGTCCACGGGCTGCCTGCCCAGACGATCCACGACGCCATTGCCAAGCTCACC

GACAACCTCGTCAACATCAACGACCAGACCGGCCACTTCCTCCTCCGCCTCCCCGACGGCCGCGTCATCGACA

CCAAGGGCTGGAACGACTGGGAGTGGACGCACGGCATCGGCCTGTATGGCCTGTACCAGTACTACACGCTCAC

CAACTCGCAGCCGACGCTGGACATCATCAAGGCGTGGTTCGCGGGGCGGCTGGCCGAGGGCACGACCAAGAAC

ATCAACACCATGTCCGTCTTCCTGACGCTGGCCTACCTGTACGACGACGACCGCCTGCGCGACGACACCTGGC

GGCCGTGGCTCGAGAGCTGGGCCGACTGGGCCATGCACGACCTGCCGCGCACGCCCTTCGGCGGCTTCCAGCA

CATCACCTACCTGGAGGAAAACGCCGGCCAGCTGTGGGACGACACGCTGATGATGACGGTCATGCCGCTGGCC

AAGATCGGCCTGGTCCTCAACCGGCCCGAGTACGTCGAGGAGGCGAAGCGCCAGTTCCTGGTGCACATGCAGT

TCCTGTTCGACCACGAGTCGGGCCTGTTCTTCCACGGCTGGCAGTTCGAGAAGGGCAAGGCGGGCTCTCTGGG
```

```
GCACAACTTCGCGCGCGCGGTGGGCGCGCGGCAACTCGTGGGTGACGATCGTGATCCCCGACTTCATCGAG

CTGCTCGACCTCAGGCCGGGCGACCCGACGCGCGAGTACCTGCTCGACATCTTCCGCGCCCAGGTCGACGCGC

TCCGTGGCCTGCAGACGCCCGACGGCCTGTGGCGGACGCTGCTCGACGAGCCCGAGTCCGCCGGCAGCTACGT

CGAGTCGTCGGCCACGGCCGGCTTCGCCTACGGCATCCTCAAGGCTGTGCGGAAGCGCTACGTCGGCCGCGAG

TACGAGGACATGGCCATCCGCGCCACCAAGGCTGTTCTGGCCAAGATCAGCCCCGACGGCGAGCTGCTCGACA

CCAGCTTCGGCACCGGCATGGGCCGCGACTACAAGCACTACTTCGACATCGAGCGGACGAGCATGCCCTACGG

CCAGGCCATGGCCATCATGACGCTCGTCGAGTTCCTGAGGTTATACCATTGAGCGCGGGTAAAAAGGAATGCG

GGCAAGGGAAATTTGCGGATCAGCCCGAATCGGGCGGCAGTATTTGTGCATAGACTATAGATAGGGATGCGAT

AACGGGTAACCAAAAAAAGGGTTATATCTTGGCAGGATGCGAAGTTGAAACCGCTT
```

```
SEQ ID NO: 182
LENGTH: 1143
TYPE: DNA
ORGANISM: M. phaseolina
FEATURE NAME/KEY: CDS
LOCATION: (1)...(1143)
atgcccaccgccctctccgtccacgggctgcctgcccagacgatccacgacgccattgcc
 M   P   T   A   L   S   V   H   G   L   P   A   Q   T   I   H   D   A   I   A aagctcaccgacaacctcgtcaacatcaacgaccagaccggccacttcctcctccgcctc
 K   L   T   D   N   L   V   N   I   N   D   Q   T   G   H   F   L   L   R   L cccgacggccgcgtcatcgacaccaagggctggaacgactgggagtggacgcacggcatc
 P   D   G   R   V   I   D   T   K   G   W   N   D   W   E   W   T   H   G   I ggcctgtatggcctgtaccagtactacacgctcaccaactcgcagccgacgctggacatc
 G   L   Y   G   L   Y   Q   Y   Y   T   L   T   N   S   Q   P   T   L   D   I atcaaggcgtggttcgcggggcggctggccgagggcacgaccaagaacatcaacaccatg
 I   K   A   W   F   A   G   R   L   A   E   G   T   T   K   N   I   N   T   M tccgtcttcctgacgctggcctacctgtacgacgacgaccgcctgcgcgacgacacctgg
 S   V   F   L   T   L   A   Y   L   Y   D   D   D   R   L   R   D   D   T   W cggccgtggctcgagagctgggccgactgggccatgcacgacctgccgcgcacgcccttc
 R   P   W   L   E   S   W   A   D   W   A   M   H   D   L   P   R   T   P   F ggcggcttccagcacatcacctacctggaggaaaacgccggccagctgtgggacgacacg
 G   G   F   Q   H   I   T   Y   L   E   E   N   A   G   Q   L   W   D   D   T ctgatgatgacggtcatgccgctggccaagatcggcctggtcctcaaccggcccgagtac
 L   M   M   T   V   M   P   L   A   K   I   G   L   V   L   N   R   P   E   Y gtcgaggaggcgaagcgccagttcctggtgcacatgcagttcctgttcgaccacgagtcg
 V   E   E   A   K   R   Q   F   L   V   H   M   Q   F   L   F   D   H   E   S ggcctgttcttccacggctggcagttcgagaagggcaaggcgggctctctggggcacaac
 G   L   F   F   H   G   W   Q   F   E   K   G   K   A   G   S   L   G   H   N ttcgcgcgcgcgcggtgggcgcgcggcaactcgtgggtgacgatcgtgatccccgacttc
 F   A   R   A   R   W   A   R   G   N   S   W   V   T   I   V   I   P   D   F atcgagctgctcgacctcaggccgggcgacccgacgcgcgagtacctgctcgacatcttc
 I   E   L   L   D   L   R   P   G   D   P   T   R   E   Y   L   L   D   I   F cgcgcccaggtcgacgcgctccgtggcctgcagacgcccgacggcctgtggcggacgctg
 R   A   Q   V   D   A   L   R   G   L   Q   T   P   D   G   L   W   R   T   L ctcgacgagcccgagtccgccggcagctacgtcgagtcgtcggccacggccggcttcgcc
 L   D   E   P   E   S   A   G   S   Y   V   E   S   S   A   T   A   G   F   A tacggcatcctcaaggctgtgcggaagcgctacgtcggccgcgagtacgaggacatggcc
 Y   G   I   L   K   A   V   R   K   R   Y   V   G   R   E   Y   E   D   M   A atccgcgccaccaaggctgttctggccaagatcagccccgacggcgagctgctcgacacc
 I   R   A   T   K   A   V   L   A   K   I   S   P   D   G   E   L   L   D   T agcttcggcaccggcatgggccgcgactacaagcactacttcgacatcgagcggacgagc
 S   F   G   T   G   M   G   R   D   Y   K   H   Y   F   D   I   E   R   T   S
```

```
atgccctacggccaggccatggccatcatgacgctcgtcgagttcctgaggttataccat
 M  P  Y  G  Q  A  M  A  I  M  T  L  V  E  F  L  R  L  Y  H tga
 -
```

SEQ ID NO: 183
LENGTH: 380
TYPE: PRT
ORGANISM: *M. phaseolina*

MPTALSVHGLPAQTIHDAIAKLTDNLVNINDQTGHFLLRLPDGRVIDTKGWNDWEWTHGIGLYGLYQYYTLTN

SQPTLDIIKAWFAGRLAEGTTKNINTMSVFLTLAYLYDDDRLRDDTWRPWLESWADWAMHDLPRTPFGGFQHI

TYLEENAGQLWDDTLMMTVMPLAKIGLVLNRPEYVEEAKRQFLVHMQFLFDHESGLFFHGWQFEKGKAGSLGH

NFARARWARGNSWVTIVIPDFIELLDLRPGDPTREYLLDIFRAQVDALRGLQTPDGLWRTLLDEPESAGSYVE

SSATAGFAYGILKAVRKRYVGREYEDMAIRATKAVLAKISPDGELLDTSFGTGMGRDYKHYFDIERTSMPYGQ

AMAIMTLVEFLRLYH*

SEQ ID NO: 184
LENGTH: 1608 (including 150 bp 5' UTR and 150 bp 3' UTR)
TYPE: DNA
ORGANISM: *M. phaseolina*

AATGTATTGTGTTCTTGGTATCATCCTTCGGACAGTTTTTCTCAAGAGTACATAAACGCCGTGTGCTGCGCAA

AGAATGGCAGCATCTCACCAGTCTAGATCTATTTTCTCAGGTGTCCATATAGTCTATCGCGCCGGTGCTTTCT

TATCATGAAGTCTTTCCTACTCGCAGCTGCTGCGgTGGCCAGTGCCACACTGGCCTCCGCAAAGATCACCTTA

CCCAACGGCTGGTTCAAAATCCCACCTGACCAGAAAATTAAGGCCGCAAAGTTTGACGGCAAGCCGCGGTACC

TGACATGGATGGCCGACTCGCAAATCAAGCACGGCGTGGAGCCGACCTTCGCCTACACCGTCTCCGCTTACCT

CTCGGGCATCAAGCTGGCGTACGACCGCACGGGCGACGAGAAGTACTACGACTACCTCAAGCGGCACACGGAC

ATCGTGCTGTACCCGGCGTGGAACGGCGAGATCCTGCTGTACAACAACAGCAACTCGATCGACGACATCCGCT

TCGGGCACACCTTCCTTGACCTGTACAACCTGACAGGCGGCGAGGAGATCTACAGGAAGGCCGCGCAGACACT

GCGTAACCAGATTGACCGCACAGGGCGCACGCCCGACGGCGGCTTCTACCACCGCTACCCGGTCTACATCGAT

CAGATGTGGCTCGACGGCATCTACATGCTCGACGTCTTCTACGCGCGCTGGACCCACGAGTTCGAGCCGGAAA

ACGCCACCGCCTGGGACGACGTCGCGCGGCAGTTCGACCTCATCGACGCGGGCACCACCGTTGACCGTGAGCG

CACGGGTGGCCTGCCCCTGCACGGCTTCGACTACAGCAAGAGCACCGTCTGGGCGGATCCGGAGACGGGCGCC

GCGCCGCATGTTTGGGGCCGCGCGGTCGGCTGGTACATAATGGCCCTTGTCGATACGCTAGATTACTTCCCGG

AGACGCATCCCGGGCGGGAGCGCCTGGTGGGGTACTTGCGGTCGCTGGCGGATGCCATTGTCGCGGCGCAGGA

CGAGCGTACGAAGGGCTGGTACAACATCATGGATCCGGGCCTCGAGGAGCGGTCGGGCAATTACATCGAGAGC

TCAGGGTCAGCCATGTTCGTGTACGGGTTGCTGAAGAGCTTGCGGAACGGGTACATCCAGGGCGAGAAATACC

TGAAGGCAGCGCTCGGTGGGTATAAGTTGATGACTGAGACGTTTGCGGAGGAGCGGAAGTCGGATGGCTCCTT

GGCTTGGGGATGGACTGTGCAGACGGGCAGTCTGAGCAGCAATGGAACCTTCGAGGTGAGTCATTTGACGTAC

TGCTTTACTGTCTTTCTTTGGAAATGCTAATCGTCTGTATAGTATTACGCCAGCATACCACTGTATGAGAACG

ACTTGAAGGGTGTTTCTCCTTTCTTGTTCGCCAGCTATGAGTATGAACTATATGTCGAGGGAGGAAAATGAGG

GCGAAATGAAACATAGGGACTCTGAAAGTGGGCTTGCGGCGATATTTCGAGGGACTGAATGAGTGAAATAGAG

TGCGGAGTGAAATACCTTTTTTGGCGAGAATTACCTGGTAGCCACAAGGAAAGACTAGATTGAGGCATACTGC

GC

SEQ ID NO: 185
LENGTH: 1248
TYPE: DNA
ORGANISM: M. phaseolina
FEATURE NAME/KEY: CDS
LOCATION: (1)...(1248)

```
atgaagtctttcctactcgcagctgctgcggtggccagtgccacactggcctccgcaaag
 M  K  S  F  L  L  A  A  A  A  V  A  S  A  T  L  A  S  A  K atcaccttacccaacggctggttcaaaatcccacctgaccagaaaattaaggccgcaaag
 I  T  L  P  N  G  W  F  K  I  P  P  D  Q  K  I  K  A  A  K tttgacggcaagccgcggtacctgacatggatggccgactcgcaaatcaagcacggcgtg
 F  D  G  K  P  R  Y  L  T  W  M  A  D  S  Q  I  K  H  G  V gagccgaccttcgcctacaccgtctccgcttacctctcgggcatcaagctggcgtacgac
 E  P  T  F  A  Y  T  V  S  A  Y  L  S  G  I  K  L  A  Y  D cgcacgggcgacgagaagtactacgactacctcaagcggcacacggacatcgtgctgtac
 R  T  G  D  E  K  Y  Y  D  Y  L  K  R  H  T  D  I  V  L  Y ccggcgtggaacggcgagatcctgctgtacaacaacagcaactcgatcgacgacatccgc
 P  A  W  N  G  E  I  L  L  Y  N  N  S  N  S  I  D  D  I  R ttcgggcacaccttccttgacctgtacaacctgacaggcggcgaggagatctacaggaag
 F  G  H  T  F  L  D  L  Y  N  L  T  G  G  E  E  I  Y  R  K gccgcgcagacactgcgtaaccagattgaccgcacgggcgcacgcccgacggcggcttc
 A  A  Q  T  L  R  N  Q  I  D  R  T  G  R  T  P  D  G  G  F taccaccgctacccggtctacatcgatcagatgtggctcgacggcatctacatgctcgac
 Y  H  R  Y  P  V  Y  I  D  Q  M  W  L  D  G  I  Y  M  L  D gtcttctacgcgcgctggacccacgagttcgagccggaaaacgccaccgcctgggacgac
 V  F  Y  A  R  W  T  H  E  F  E  P  E  N  A  T  A  W  D  D gtcgcgcggcagttcgacctcatcgacgcgggcaccaccgttgaccgtgagcgcacgggt
 V  A  R  Q  F  D  L  I  D  A  G  T  T  V  D  R  E  R  T  G ggcctgcccctgcacggcttcgactacagcaagagcaccgtctggcggatccggagacg
 G  L  P  L  H  G  F  D  Y  S  K  S  T  V  W  A  D  P  E  T ggcgccgcgccgcatgtttggggccgcgcggtcggctggtacataatggcccttgtcgat
 G  A  A  P  H  V  W  G  R  A  V  G  W  Y  I  M  A  L  V  D acgctagattacttcccggagacgcatcccgggcgggagcgcctggtggggtacttgcgg
 T  L  D  Y  F  P  E  T  H  P  G  R  E  R  L  V  G  Y  L  R tcgctggcggatgccattgtcgcggcgcaggacgagcgtacgaagggctggtacaacatc
 S  L  A  D  A  I  V  A  A  Q  D  E  R  T  K  G  W  Y  N  I atggatccgggcctcgaggagcggtcgggcaattacatcgagagctcagggtcagccatg
 M  D  P  G  L  E  E  R  S  G  N  Y  I  E  S  S  G  S  A  M ttcgtgtacgggttgctgaagagcttgcggaacgggtacatccagggcgagaaatacctg
 F  V  Y  G  L  L  K  S  L  R  N  G  Y  I  Q  G  E  K  Y  L aaggcagcgctcggtgggtataagttgatgactgagacgtttgcggaggagcggaagtcg
 K  A  A  L  G  G  Y  K  L  M  T  E  T  F  A  E  E  R  K  S gatggctccttggcttggggatggactgtgcagacgggcagtctgagcagcaatggaacc
 D  G  S  L  A  W  G  W  T  V  Q  T  G  S  L  S  S  N  G  T ttcgagtattacgccagcataccactgtatgagaacgacttgaagggtgtttctcctttc
 F  E  Y  Y  A  S  I  P  L  Y  E  N  D  L  K  G  V  S  P  F ttgttcgccagctatgagtatgaactatatgtcgagggaggaaaatga
 L  F  A  S  Y  E  Y  E  L  Y  V  E  G  G  K  -
```

SEQ ID NO: 186
LENGTH: 415
TYPE: PRT
ORGANISM: M. phaseolina

MKSFLLAAAAVASATLASAKITLPNGWFKIPPDQKIKAAKFDGKPRYLTWMADSQIKHGVEPTFAYTVSAYLS

GIKLAYDRTGDEKYYDYLKRHTDIVLYPAWNGEILLYNNSNSIDDIRFGHTFLDLYNLTGGEEIYRKAAQTLR

NQIDRTGRTPDGGFYHRYPVYIDQMWLDGIYMLDVFYARWTHEFEPENATAWDDVARQFDLIDAGTTVDRERT

GGLPLHGFDYSKSTVWADPETGAAPHVWGRAVGWYIMALVDTLDYFPETHPGRERLVGYLRSLADAIVAAQDE

-continued

RTKGWYNIMDPGLEERSGNYIESSGSAMFVYGLLKSLRNGYIQGEKYLKAALGGYKLMTETFAEERKSDGSLA

WGWTVQTGSLSSNGTFEYYASIPLYENDLKGVSPFLFASYEYELYVEGGK*

```
SEQ ID NO: 187
LENGTH: 1534 (including 150 bp 5' UTR and 150 bp 3' UTR)
TYPE: DNA
ORGANISM: M. phaseolina
CATGTCCCGCATCATGCCAGAATATAAGGCTGCCCTGGACGGCTGTTTTGTTTCGTTTCTTTCGTCACTGGAG

CCCTCCTTTCCTTCCGTTGCCCCTCGCTCACTTCCCAGCACAAACGCGGGCTCGACGCTTGCTCCGATTCCGC

CGCCATGAAGCTTTCTTCCTTTGCCGCCGCCGCGGCGCTCTCCGCTTCCACGGCCGCCGCCCAGGCCCAGCAG

AAGTACTCGACTTGGATGGCCGACTCCCTCATCcTCAAGAACATCGCGGCGGACAACCACTACACAAATGCCG

TCCTCTACCGCGGGATCGACCTCGTCTACAAGGCGTACGGCAATGAGTCGTACTACACCTGGGTCAAGGAGCA

GCTGGACCAGATTGTCAGCGACAACGGCACCATCGCGACCTACCCCACGGACAAGGACTCGCTCGACGACATC

CTGCTGGGCCGCGCTCTGCTGGAGCTGTACGGCCAGACCAACGCCACCAAGTACAAGGCGGCGGCCGGCCTGC

TTCGCGAGCAGCTCAACTTCCAGGCGCGCACGCCCGCTGGCGGCTTCTGGCACCGCGTGCCCACGTACCCCAA

CCAGATGTGGCTGGACGGCATCTACATGGCCGACGTCTTCTACGCGCAGTGGACCGCCGCCTTTGAGCCCACC

AACACCACCGCCTGGGACGACATCCTGCTGCAGTACGAGCTGATCGAGCAGCACCTGCGCAACAAGACGTCCA

ACCTGCTGTACCACGGCTACGACGAGCTGAAGAAGGCCGTGTGGGCTGACCCGGTGACGGGTGCCTCGCCCCA

CGTCTGGGATCGTGCTCTGGGCTGGTACGTCATGGCGCTCCTGGACGTGCTCGACTACTTCCCCAAGGACCAC

GCCGGCCACCAGAAGCTCATCGACTGGTACGTCGCGTGCGCGGACGGCATTCTCGCTGCGCAGGACGCCGAGA

CCGGCGGCTGGTGGCTGGTCATGGACGAGCCGTACCCGGGCATGGCTGGCAACTACATCGAGAGCTCCGGCAC

CGCCATGTTCACCTACGGCCTGCTCAAGGGCGCGCATGGGCTACATCAGCGACGAGAAGTACACCGCCGCT

GCGACCAAGGCATACGAGCTCATGACCACTGAGTACGCTGTTGCCAACGCTACCGGCGGCATGCTGAACTGGG

AGGGCACCGTCGAGGTCGGCAGCTTGAGCGGCAATGCTTCCTACCAGGTGGGTCTCCAATTCTCCTTCACCGC

TACATCCTCATCCTTCGTGAATGATCTGCTAACACGCGGCCTGCCTTCAGTACTACATCGGCGTCCCGCTCGC

CGAGAACGACCTGAAGGGCGCTGGTCCCTTCATCTACGCCGCTCTCGAGTACGAGGCCTTCACGGCGTAGAGA

GGTGTATCTGGAGTAGCTGTACATACCGCAACGCTTTTATCATATTCACTGTCCAAATATTTCACGCCGAACA

AAAAAAaGAAATGGAGACGCATTTGCCAATGACCATGGCGGGCCCGTCCGCGTGACTGCTGCCCGAATGACCA

A

SEQ ID NO: 188
LENGTH: 1158
TYPE: DNA
ORGANISM: M. phaseolina
FEATURE NAME/KEY: CDS
LOCATION: (1)...(1158)
atgaagctttcttcctttgccgccgccgcggcgctctccgcttccacggccgccgcccag
 M   K   L   S   S   F   A   A   A   A   A   L   S   A   S   T   A   A   A   Q gcccagcagaagtactcgacttggatggccgactccctcatcctcaagaacatcgcggcg
 A   Q   Q   K   Y   S   T   W   M   A   D   S   L   I   L   K   N   I   A   A gacaaccactacacaaatgccgtcctctaccgcgggatcgacctcgtctacaaggcgtac
 D   N   H   Y   T   N   A   V   L   Y   R   G   I   D   L   V   Y   K   A   Y ggcaatgagtcgtactacacctgggtcaaggagcagctggaccagattgtcagcgacaac
 G   N   E   S   Y   Y   T   W   V   K   E   Q   L   D   Q   I   V   S   D   N ggcaccatcgcgacctaccccacggacaaggactcgctcgacgacatcctgctgggccgc
 G   T   I   A   T   Y   P   T   D   K   D   S   L   D   D   I   L   L   G   R gctctgctggagctgtacggccagaccaacgccaccaagtacaaggcggcggccggcctg
 A   L   L   E   L   Y   G   Q   T   N   A   T   K   Y   K   A   A   A   G   L cttcgcgagcagctcaacttccaggcgcgcacgcccgctggcggcttctggcaccgcgtg
 L   R   E   Q   L   N   F   Q   A   R   T   P   A   G   G   F   W   H   R   V cccacgtaccccaaccagatgtggctggacggcatctacatggccgacgtcttctacgcg
 P   T   Y   P   N   Q   M   W   L   D   G   I   Y   M   A   D   V   F   Y   A
```

```
cagtggaccgccgcctttgagcccaccaacaccaccgcctgggacgacatcctgctgcag
 Q   W   T   A   A   F   E   P   T   N   T   T   A   W   D   D   I   L   L   Q tacgagctgatcgagcagcacctgcgcaacaagacgtccaacctgctgtaccacggctac
 Y   E   L   I   E   Q   H   L   R   N   K   T   S   N   L   L   Y   H   G   Y gacgagctgaagaaggccgtgtgggctgacccggtgacgggtgcctcgccccacgtctgg
 D   E   L   K   K   A   V   W   A   D   P   V   T   G   A   S   P   H   V   W gatcgtgctctgggctggtacgtcatggcgctcctggacgtgctcgactacttccccaag
 D   R   A   L   G   W   Y   V   M   A   L   L   D   V   L   D   Y   F   P   K gaccacgccggccaccagaagctcatcgactggtacgtcgcgtgcgcggacggcattctc
 D   H   A   G   H   Q   K   L   I   D   W   Y   V   A   C   A   D   G   I   L gctgcgcaggacgccgagaccggcggctggtggctggtcatggacgagccgtacccgggc
 A   A   Q   D   A   E   T   G   G   W   W   L   V   M   D   E   P   Y   P   G atggctggcaactacatcgagagctccggcaccgccatgttcacctacggcctgctcaag
 M   A   G   N   Y   I   E   S   S   G   T   A   M   F   T   Y   G   L   L   K ggcgcgcgcatgggctacatcagcgacgagaagtacaccgccgctgcgaccaaggcatac
 G   A   R   M   G   Y   I   S   D   E   K   Y   T   A   A   A   T   K   A   Y gagctcatgaccactgagtacgctgttgccaacgctaccggcggcatgctgaactgggag
 E   L   M   T   T   E   Y   A   V   A   N   A   T   G   G   M   L   N   W   E ggcaccgtcgaggtcggcagcttgagcggcaatgcttcctaccagtactacatcggcgtc
 G   T   V   E   V   G   S   L   S   G   N   A   S   Y   Q   Y   Y   I   G   V ccgctcgccgagaacgacctgaagggcgctggtcccttcatctacgccgctctcgagtac
 P   L   A   E   N   D   L   K   G   A   G   P   F   I   Y   A   A   L   E   Y gaggccttcacggcgtag
 E   A   F   T   A   -

SEQ ID NO: 189
LENGTH: 385
TYPE: PRT
ORGANISM: M. phaseolina
MKLSSFAAAAALSASTAAAQAQQKYSTWMADSLILKNIAADNHYTNAVLYRGIDLVYKAYGNESYYTWVKEQL

DQIVSDNGTIATYPTDKDSLDDILLGRALLELYGQTNATKYKAAAGLLREQLNFQARTPAGGFWHRVPTYPNQ

MWLDGIYMADVFYAQWTAAFEPTNTTAWDDILLQYELIEQHLRNKTSNLLYHGYDELKKAVWADPVTGASPHV

WDRALGWYVMALLDVLDYFPKDHAGHQKLIDWYVACADGILAAQDAETGGWWLVMDEPYPGMAGNYIESSGTA

MFTYGLLKGARMGYISDEKYTAAATKAYELMTTEYAVANATGGMLNWEGTVEVGSLSGNASYQYYIGVPLAEN

DLKGAGPFIYAALEYEAFTA*

SEQ ID NO: 190
LENGTH: 1542 (including 150 bp 5' UTR and 150 bp 3' UTR)
TYPE: DNA
ORGANISM: M. phaseolina
CGACGAGCCTTCAGCGCAGCCGTGCCTCTCTGGCCTCGCAAGAGTCGGTAGCTCCGGCGCCAATTCCCAATCG

GGCAACTTGATCTTCTCCAGACACAAAACCAACACTTCCCCTCCGCCCAGCTGCTCCGTCCCCGGCCAACCGC

AACCATGACCTCGGCCTTGGTCGAGAGAATCATCTCCCAAGGCTACCGTCTGGCAAGCCACAGCTGGGAGTAC

GGCACCTTCGCCGAAGCTCTGCTGGAGTGGTACGATCCCTACTACAGCGTCTTCGGCAACAACCCCTTCCCGG

ATGGCAAGATCCCCGTCGCCAACGTCTCCGACGTCCGCGCATTGACTTACGTCAAACCTCACATCTCCATCAA

TTCGTCTGCTCTGGTTGATGGCAATGGTACGTTTTCTGTCATCAGTGTCGTCCTCCAGCCTCCTCCCATTTTT

ATCCGTCCGACCTCGCTCTATGCAACTGGCATCACACGCACCCTGTATATCCACCGAACCCACACTGACCGCC

GCCCACCAGGCTCCGCCGGCGACCCCGCCTCTCTGGGCGTTGCCGCCATCCTGATCGGCCAAACGCAACCAGC

CTACCTCGCCGCCGCCGGCCGCCAAGTCGAGCACCTTCTCACGACCGTCCCCcGCTGGTCCAACGGCGCCATC

TCGCACCGCGAAGACGTCGCTGAGCTCTGGGCCGACTCGATTTACATGGCGCCGCCCACTCTCGCCTACTACG

GCGTTGCGACATCCAACATAACCCTCCTCTCCGAATCCATCGCCCAGTGCAACGCCTACCGCGACGTGCTCTC

CGTGCCCGCCGCCTCCTCCTCCTCCTCCGCCGCCGCCGCCGGCCTCTGGCACCATATCATCGGCCCGCAATCG

CAAGACCTGGGCATCTGGAGCACGGGCAACGCGTGGGCAGCGGCCGGCATGGCGCGCGTGCTCGCGACGGCCA
```

```
AGAAGTCGCCCTTCGCGCACGAACTCGCCCCGGCCATCGCAGAGCTCGGCGCGAACATCAAAGTCCTCCTCGA

CGGCGCCATGGCCGTCGACGCGCGCGAGCCGGCCGAGCCGCTGCTGCGCAACTACCTCAACGACACGGCCTGG

TTCGGCGAGCTGTCGGGCACCACGCTGCTGACGGCCGTCGCGTACCGCATGCTCAGCCTCGAGCCCGGCACGT

TTGCGGTCGAGCGCTACGGCAAGTGGGCCGATGAGAAGAGGGAGGCGGTGACGGCGCGGATTGGCGACGATGG

TCTGCTGGCGCCCGTCGTCAATCCGCTGGACTGGTATGATACCACGCCCGGCACCCAGTCGCCCGAGGCGCAG

GCGTTTGCCGTCTTGATGTTTGCTGCACACAGGAGCTTTTGTCAGGGGGCGCTTGCGAGATGCCAGTCTCTG

ATTGATGGGAGTGATGGAAGCTCGGATGGCACTCGCTCATGAGCGCTCCCTTTTTATTTATTTATTTTtTTTT

TtCTGAGCGAATCATGAGATATGTTACTGAATTACAGATATGAAGTTCTTATATATTGAATTCAAGACACGAA

AAGACTGCT
```

```
SEQ ID NO: 191
LENGTH: 1113
TYPE: DNA
ORGANISM: M. phaseolina
FEATURE NAME/KEY: CDS
LOCATION: (1)...(1113)
atgacctcggccttggtcgagagaatcatctcccaaggctaccgtctggcaagccacagc
 M   T   S   A   L   V   E   R   I   I   S   Q   G   Y   R   L   A   S   H   S tgggagtacggcaccttcgccgaagctctgctggagtggtacgatccctactacagcgtc
 W   E   Y   G   T   F   A   E   A   L   L   E   W   Y   D   P   Y   Y   S   V ttcggcaacaaccccttcccggatggcaagatccccgtcgcaacgtctccgacgtccgc
 F   G   N   N   P   F   P   D   G   K   I   P   V   A   N   V   S   D   V   R gcattgacttacgtcaaacctcacatctccatcaattcgtctgctctggttgatggcaat
 A   L   T   Y   V   K   P   H   I   S   I   N   S   S   A   L   V   D   G   N ggctccgccggcgaccccgcctctctgggcgttgccgccatcctgatcggccaaacgcaa
 G   S   A   G   D   P   A   S   L   G   V   A   A   I   L   I   G   Q   T   Q ccagcctacctcgccgccgccggccgccaagtcgagcaccttctcacgaccgtccccgc
 P   A   Y   L   A   A   A   G   R   Q   V   E   H   L   L   T   T   V   P   R tggtccaacggcgccatctcgcaccgcgaagacgtcgctgagctctgggccgactcgatt
 W   S   N   G   A   I   S   H   R   E   D   V   A   E   L   W   A   D   S   I tacatggcgccgcccactctcgcctactacggcgttgcgacatccaacataaccctcctc
 Y   M   A   P   P   T   L   A   Y   Y   G   V   A   T   S   N   I   T   L   L tccgaatccatcgcccagtgcaacgcctaccgcgacgtgctctccgtgcccgccgcctcc
 S   E   S   I   A   Q   C   N   A   Y   R   D   V   L   S   V   P   A   A   S tcctcctcctccgccgccgccgccggcctctggcaccatatcatcggcccgcaatcgcaa
 S   S   S   S   A   A   A   A   G   L   W   H   H   I   I   G   P   Q   S   Q gacctgggcatctggagcacgggcaacgcgtgggcagcggccggcatggcgcgcgtgctc
 D   L   G   I   W   S   T   G   N   A   W   A   A   A   G   M   A   R   V   L gcgacggccaagaagtcgcccttcgcgcacgaactcgccccggccatcgcagagctcggc
 A   T   A   K   K   S   P   F   A   H   E   L   A   P   A   I   A   E   L   G gcgaacatcaaagtcctcctcgacggcgccatggccgtcgacgcgcgcgagccggccgag
 A   N   I   K   V   L   L   D   G   A   M   A   V   D   A   R   E   P   A   E ccgctgctgcgcaactacctcaacgacacggcctggttcggcgagctgtcgggcaccacg
 P   L   L   R   N   Y   L   N   D   T   A   W   F   G   E   L   S   G   T   T ctgctgacggccgtcgcgtaccgcatgctcagcctcgagcccggcacgtttgcggtcgag
 L   L   T   A   V   A   Y   R   M   L   S   L   E   P   G   T   F   A   V   E cgctacggcaagtgggccgatgagaagagggaggcggtgacggcgcggattggcgacgat
 R   Y   G   K   W   A   D   E   K   R   E   A   V   T   A   R   I   G   D   D ggtctgctggcgcccgtcgtcaatccgctggactggtatgataccacgcccggcacccag
 G   L   L   A   P   V   V   N   P   L   D   W   Y   D   T   T   P   G   T   Q tcgcccgaggcgcaggcgtttgccgtcttgatgtttgctgcacacaggagcttttgtcag
 S   P   E   A   Q   A   F   A   V   L   M   F   A   A   H   R   S   F   C   Q gggggcgcttgcgagatgccagtctctgattga
 G   G   A   C   E   M   P   V   S   D   -
```

SEQ ID NO: 192
LENGTH: 370
TYPE: PRT
ORGANISM: M. phaseolina
MTSALVERIISQGYRLASHSWEYGTFAEALLEWYDPYYSVFGNNPFPDGKIPVANVSDVRALTYVKPHISINS

SALVDGNGSAGDPASLGVAAILIGQTQPAYLAAAGRQVEHLLTTVPRWSNGAISHREDVAELWADSIYMAPPT

LAYYGVATSNITLLSESIAQCNAYRDVLSVPAASSSSSAAAAGLWHHIIGPQSQDLGIWSTGNAWAAAGMARV

LATAKKSPFAHELAPAIAELGANIKVLLDGAMAVDAREPAEPLLRNYLNDTAWFGELSGTTLLTAVAYRMLSL

EPGTFAVERYGKWADEKREAVTARIGDDGLLAPVVNPLDWYDTTPGTQSPEAQAFAVLMFAAHRSFCQGGACE

MPVSD*

SEQ ID NO: 193
LENGTH: 2042 (including 150 bp 5' UTR and 150 bp 3' UTR)
TYPE: DNA
ORGANISM: M. phaseolina
TCGTCGGTGCGAGCCTGAGCCACCGCCTTCGCTCTCAACCCGCCCTTTTAGTCGCTTTGTGCCTCGCGCTCCG

CTCCCTCTGAAACATTCTCCATCCGCTGCTTCTTCGCCGTTTCGATACCCCATAGCGCGCGCCTTCTTCGCAC

CGTCATGCTTGTTCGCTTCTCCCTCTCCGGCGCGGCCCTGCTGCTATGCGCCGACGCCTTCGTCATCCCCGCC

GTTCTGGACAGCCAGAAGCCGCTGGCCGGCAACGCCCTGTCCGACCTCGCCGCCAAAGTCCATGCTCTTTCCG

ACCAACTCGCCCTCCGACCCACCACCAAGTCGTCCCTGGATACATGGCTGGACAAGGAGGAGGACATCGCCGT

GGATCGGTTGCTGGCCAACATTGCGCCGAGCGGCAGGAATGCGCAACACGCTGCGCCTGGCACCGTTCTTGCC

AGTCCATCCAAGGAGCACCCCAACTACTACTACCAATGTGAGTTCCTCGCGCGCGCTTTGCTGTCGTCGTCGT

CGCTGACCCGTGTGCGCTCCTAGGGGTTCGTGATGCCGGTATAACCATGGCCACCGTCGTGGATCTGTACCTC

GCCGATCCTTCCTCAGAGCTCAGCAGAACGGTGCTGCTGCCCACGCTCGAATCCTATGCTTCCATCTCCCAGA

AGATCCAACAGACTCCCAACCCGTCGGGCGACTTCTCCTTCCCCGACCTCAACGGGCTCGGCGAGCCGAAGTT

CGAGGCCGATGGCTCCGCCTTCACCTCCAACTGGGGCCGCCCGCAGCGCGACGGCCCCGCTCTGAGGTCGATC

GCGCTCATGAAGTTCATGCGCGCATACAACGAGAGCAACCCTGGCCTGTGGGAATCCAGGACCACGTCGACCA

ACGACTGGTTCACCAAGCTGTACAGCCCGGACCTGCCCGCGCGCAGCATCATCAAGGCTGACCTGGAATACGT

CGCGCGCCACTGGCCCGAGTCGGGCTTCGACGTGTGGGAGGAGGTCCAGGGCCGGCACTTCTTCACCGCCATG

GCACAGCTGCGCGCACTGCGCGAGGGCGCCGAGCTGGCTGCGCTCTTCAACGACGCCGGCGCTGCCGCCTACT

ACCGCGACCAGGCGGCGAAGCTGGAAGCCATGATCGCATCCGACTTCTGGGACAAGCGGGGCGGCTACCTGCG

CGCCACGCGCGGCGGCGACGCCGAGTTCCAGCGCTCCGGCATGGACTGCAGCGTCCTGCTCGGCAGCATCCAC

GGCAACGCCCTCGAGCCCGCGTCGCCCGATGCGCCGCTCTTCCCGCCCCACGACGACAAGGTGCTCGTCTCGC

TCATGAAGCTTGTGCAGGACCAGCGCGACCGCTTCCCCATCAACGCCCAGCCCGAGAGCCCCGAGGCCGGCGA

CGACTCCTCTTTCGCTGAAAGCGACCCATTGCGCCCCGCGGGCGTCGGCCGCTACCCCGAGGATGCCTACGAC

GGCTACGCCTCCCCCCACCCCGGCGCCGGCAACCCGTGGTTCCTGTGCACGGCTAGCGTCGCCGAGATCCTGT

TCCGCACCAGCGCGCACGTCAACGCGACGGGCGTCGTCACCGTCTCGGAGAGCGGCTGGGACTTCTGGCGAGG

CCTCGTTTGCCCGTCATCGTCGTCGTCGGACAAGGACTGCGCCCTCTCGTGGGAGCGCAAGCGCTACACG

GCCGGTGACGGCACCGGCGTCGTCGAGAAGGCGCAGCTGCGCTTGAAGGCCATCGGCGATGGGTTCTTGGCCG

TCGTCAAGAGGCACGCGAAGGGCGATGGTGCGCTGAGCGAGCAGTTCGATCGGTGGACCGGGTTTGAGCGCGG

AGCCGAGGATTTGACGTGGAGCTACGGCGCGTTTTTGCAGGCGGTGTGGGCGAGGCAGAGGTTGTGAGAGGTG

AGTGAGGCTGTCGTGAGGAACGTAGGCGGAGAGGCTGTGCGCGGGCTGGGTAAGCGAGAGGAACTTTGAGCGT

CGCGGCAGGATTGGGGAAATTGCTACTTTAGCGAGAGTGCGGTGTTATTTTTtCCGTtGGGATGGATCGGA

SEQ ID NO: 194
LENGTH: 1683
TYPE: DNA
ORGANISM: M. phaseolina
FEATURE NAME/KEY: CDS
LOCATION: (1)...(1683)

```
atgcttgttcgcttctccctctccggcgcggccctgctgctatgcgccgacgccttcgtc
 M   L   V   R   F   S   L   S   G   A   A   L   L   L   C   A   D   A   F   V atccccgccgttctggacagccagaagccgctggccggcaacgccctgtccgacctcgcc
 I   P   A   V   L   D   S   Q   K   P   L   A   G   N   A   L   S   D   L   A gccaaagtccatgctctttccgaccaactcgccctcgaccaccaccaagtcgtccctg
 A   K   V   H   A   L   S   D   Q   L   A   L   R   P   T   T   K   S   S   L gatacatggctggacaaggaggaggacatcgccgtggatcggttgctggccaacattgcg
 D   T   W   L   D   K   E   E   D   I   A   V   D   R   L   L   A   N   I   A ccgagcggcaggaatgcgcaacacgctgcgcctggcaccgttcttgccagtccatccaag
 P   S   G   R   N   A   Q   H   A   A   P   G   T   V   L   A   S   P   S   K gagcaccccaactactactaccaatgggttcgtgatgccggtataaccatggccaccgtc
 E   H   P   N   Y   Y   Y   Q   W   V   R   D   A   G   I   T   M   A   T   V gtggatctgtacctcgccgatccttcctcagagctcagcagaacggtgctgctgcccacg
 V   D   L   Y   L   A   D   P   S   S   E   L   S   R   T   V   L   L   P   T ctcgaatcctatgcttccatctcccagaagatccaacagactcccaacccgtcgggcgac
 L   E   S   Y   A   S   I   S   Q   K   I   Q   Q   T   P   N   P   S   G   D ttctccttccccgacctcaacgggctcggcgagccgaagttcgaggccgatggctccgcc
 F   S   F   P   D   L   N   G   L   G   E   P   K   F   E   A   D   G   S   A ttcacctccaactgggccgcccgcagcgcgacggccccgctctgaggtcgatcgcgctc
 F   T   S   N   W   G   R   P   Q   R   D   G   P   A   L   R   S   I   A   L atgaagttcatgcgcgcatacaacgagagcaaccctggcctgtgggaatccaggaccacg
 M   K   F   M   R   A   Y   N   E   S   N   P   G   L   W   E   S   R   T   T tcgaccaacgactggttcaccaagctgtacagcccggacctgcccgcgcgcagcatcatc
 S   T   N   D   W   F   T   K   L   Y   S   P   D   L   P   A   R   S   I   I aaggctgacctggaatacgtcgcgcgccactggcccgagtcgggcttcgacgtgtgggag
 K   A   D   L   E   Y   V   A   R   H   W   P   E   S   G   F   D   V   W   E gaggtccagggccggcacttcttcaccgccatggcacagctgcgcgcactgcgcgagggc
 E   V   Q   G   R   H   F   F   T   A   M   A   Q   L   R   A   L   R   E   G gccgagctggctgcgctcttcaacgacgccggcgctgccgcctactaccgcgaccaggcg
 A   E   L   A   A   L   F   N   D   A   G   A   A   A   Y   Y   R   D   Q   A gcgaagctggaagccatgatcgcatccgacttctgggacaagcggggcggctacctgcgc
 A   K   L   E   A   M   I   A   S   D   F   W   D   K   R   G   G   Y   L   R gccacgcgcggcggcgacgccgagttccagcgctccggcatggactgcagcgtcctgctc
 A   T   R   G   G   D   A   E   F   Q   R   S   G   M   D   C   S   V   L   L ggcagcatccacggcaacgccctcgagcccgcgtcgccgatgcgccgctcttcccgccc
 G   S   I   H   G   N   A   L   E   P   A   S   P   D   A   P   L   F   P   P cacgacgacaaggtgctcgtctcgctcatgaagcttgtgcaggaccagcgcgaccgcttc
 H   D   D   K   V   L   V   S   L   M   K   L   V   Q   D   Q   R   D   R   F cccatcaacgcccagcccgagagccccgaggccggcgacgactcctctttcgctgaaagc
 P   I   N   A   Q   P   E   S   P   E   A   G   D   D   S   S   F   A   E   S gacccattgcgcccgcgggcgtcggccgctaccccgaggatgcctacgacggctacgcc
 D   P   L   R   P   A   G   V   G   R   Y   P   E   D   A   Y   D   G   Y   A tcccccaccccggcgccggcaacccgtggttcctgtgcacggctagcgtcgccgagatc
 S   P   H   P   G   A   G   N   P   W   F   L   C   T   A   S   V   A   E   I ctgttccgcaccagcgcgcacgtcaacgcgacgggcgtcgtcaccgtctcggagagcggc
 L   F   R   T   S   A   H   V   N   A   T   G   V   V   T   V   S   E   S   G tgggacttctggcgaggcctcgtttgcccgtcatcgtcgtcgtcgtcggacaaggactgc
 W   D   F   W   R   G   L   V   C   P   S   S   S   S   S   S   D   K   D   C gccctctcgtgggagcgcaagcgctacacggccggtgacggcaccggcgtcgtcgagaag
 A   L   S   W   E   R   K   R   Y   T   A   G   D   G   T   G   V   V   E   K
```

```
gcgcagctgcgcttgaaggccatcggcgatgggttcttggccgtcgtcaagaggcacgcg
 A  Q  L  R  L  K  A  I  G  D  G  F  L  A  V  V  K  R  H  A aagggcgatggtgcgctgagcgagcagttcgatcggtggaccgggtttgagcgcggagcc
 K  G  D  G  A  L  S  E  Q  F  D  R  W  T  G  F  E  R  G  A gaggatttgacgtggagctacggcgcgttttttgcaggcggtgtgggcgaggcagaggttg
 E  D  L  T  W  S  Y  G  A  F  L  Q  A  V  W  A  R  Q  R  L tga
 -
```

SEQ ID NO: 195
LENGTH: 560
TYPE: PRT
ORGANISM: M. phaseolina

MLVRFSLSGAALLLCADAFVIPAVLDSQKPLAGNALSDLAAKVHALSDQLALRPTTKSSLDTWLDKEEDIAVD

RLLANIAPSGRNAQHAAPGTVLASPSKEHPNYYYQWVRDAGITMATVVDLYLADPSSELSRTVLLPTLESYAS

ISQKIQQTPNPSGDFSFPDLNGLGEPKFEADGSAFTSNWGRPQRDGPALRSIALMKFMRAYNESNPGLWESRT

TSTNDWFTKLYSPDLPARSIIKADLEYVARHWPESGFDVWEEVQGRHFFTAMAQLRALREGAELAALFNDAGA

AAYYRDQAAKLEAMIASDFWDKRGGYLRATRGGDAEFQRSGMDCSVLLGSIHGNALEPASPDAPLFPPHDDKV

LVSLMKLVQDQRDRFPINAQPESPEAGDDSSFAESDPLRPAGVGRYPEDAYDGYASPHPGAGNPWFLCTASVA

EILFRTSAHVNATGVVTVSESGWDFWRGLVCPSSSSSSDKDCALSWERKRYTAGDGTGVVEKAQLRLKAIGDG

FLAVVKRHAKGDGALSEQFDRWTGFERGAEDLTWSYGAFLQAVWARQRL*

SEQ ID NO: 196
LENGTH: 2679 (including 150 bp 5' UTR and 150 bp 3' UTR)
TYPE: DNA
ORGANISM: M. phaseolina
ACACTTGTTGGTGTCGTGACTCGCAAATGCCAATATAAAAGGGGACGCACTCCGCGCACCAACAAGAAGCCG

TTTGAAAGACAGCAGCGCAGAACCTTTTGCAGCCAGCCTCCTTCTCTGACCTTGGGTACTTCTGGATACGCTC

CACAATGCTCTTTCCCTCCAAGGCCCTGGCCCTCGTCGGCCTCTTGGTCGGCGACGCCCTTGCCATCCCGGCC

ACCACGCTGCGGAAGCGCCAGAGCAGCGTCGATACCTTTATTTCGACTGAGAGCCCGATCGCATATGCCGGTG

TGCTCGCCAACATTGGTGACGATGGCTCAAAGGTCGCCGGCGCTGCGGCCGGCATCGTCGTAGCGAGTCCGAG

CAAGAGTAACCCTGATTGTATGTACTAATCCCGCTAATACCTCTGATTCAACTTGCTTCCGCTTCTGCGGATG

TTCTTTCTTTTGCCGCCGTTGGGCAATGGTGCTGACGGAATGATAGATTTCTACACCTGGACTCGCGATGCAT

CCCTTGTCTTCAAGGCGCTTGTTGACCACTTCATCGCCGGCGATTACTCCCTGCAGGACGAGATTGAGGATTT

CATCATCTCGCAAGCGAAGTTGCAGGGCGTGTCCAACCCGTCCGGTGACCTAAGATCTGGTGCTGGTCTTGTA

AGTGAAGCTTTCGTGTTCTGCCCCGCATGGCCAGCCCCAAATTATCCTTGAGGCCCGCATTCTATGGCCAAAC

TCGCGGCACATAAGATGTGGGAGTTTTGCAAGAGCATCGCTTCTGGTACATTTGAGACTTCAGATATCATGAG

CACCTCAACCTTGTAGTCAGCGATTGGCTGTCGATTTTATCTTCAGCTCTTATTACAACAAACCAGTGCTTGA

GAACCTAACATTTCGTGCGCAGGGCGAGCCCAAGTTCAATGTTGATCTGACCCAATTCACCGGTGCTTGGGGA

AGGCCGCAAAGAGATGGACCGGCCCTCCGCGCcACCTCTATGATTGCCTACGCTCACTGGTTGATCAACAACG

GTTACAGCGACACCGCTAGAGATGTTGTGTGGCCCGTCATTAGGAACGATCTGTCTTACGTTTCTCAATACTG

GAACCAGACCGGTTTTGACCTTTGGTAATAAATTCCCAATGCCACGATCTGACAGATCAAAACTCAATGCTAA

CGCAATGACACAGGGAGGAGGTTCAAGGCTCATCCTTTTTCACCATTGCGGTCTCGCACCGTGCTTTAGTCGA

GGGCAGCACCCTCGCTTCTGCGCTCGGCCAGAGCTGCAGCTACTGTGACTCTCAGGCACCTCAAACTCTCTGC

TTCCTGCAAAGCTTCTGGACTTCCAACGGCAACTACGTCGTCTCCAACATCAACACCAACAACGGCCGAACCG

GAAAGGATGCCAACTCCATCCTTGCTTCCATTCACACGTTCGATCCTGATGCGGGTTGTGATGACAGTACCTT

CCAGCCCTGCTCTGCACGTGCACTGGCGAACCACAAGGCTGTGACTGACTCTTTCCGCTCCATCTATAACATC

AACTCCGGCATTGCTCAGGGCCGGGCTGTTGCTGTGGGTAGATATGCTGAGGATGTCTATTACAACGGTAACC

CCTGGTAAGCAAATCCCCTGGAATCGATCAGACACAACAGTGGCTAACAGTTAAACAGGTACCTCACCACTCT

-continued

```
CGCTGCTGCCGAGCAGCTCTACGATGCGCTCTACACCTGGACCCGCGAGGGCACTATAACCATCACCTCCGTC

TCCCTGCCTTTCTTCCGGGATATCTACTCCTCCGCAGCAGTCGGCACCTACGCATCCGGCAGCGCCGCCTACA

CCTCAATCCTCAATGCCGTCAAGACCTACGCCGACGGCTACGTCTCCGTCGTCCAGAAGTACACGCCCTCTTC

CGGCGCGTTAGCCGAGCAGTACTCGCGCAACGATGGCTCGCCGCTGTCGGCCGCCGACCTGACCTGGTCCTAC

GCCGCCTTCCTGACGGCCATTGCGCGCCGCAACTCGATCGTGCCGGCTTCGTGGGCGGCGAGACGGCCAATG

TCGTGCCCGGCAGCTGCGTCGCTACCAGCGCAATCGGCACCTACGCTTCGGCAACCAACACCGTCTTCCCCAC

TTCACAAACTAGCAACCCGGGCGCCACCACCACCCGTCCCCCTACCAGCTCGACCACGACAACCAGGGTCACC

AGCAGCACCACCACCACGACAACTAACCCTACATCTGTCGCCGTCACCTTCAACGTCATCGCCACCACCGTCT

TCGGCGAGAACATCTTCCTTGCTGGCAGCATCGCTGCGCTGGGCTCGTGGGCCCCCGCATCCGCCAAGGCCCT

TAGCGCGGATAAGTATACTAGCAGTAACAATTTGTGGTATGTGACGGTCAGCTTGGCCCCTGGGACTAGCTTC

CAGTACAAGTACATTCGCAAGAGCAGCAGCGGCGCGTACACCTGGGAGAGCGATCCGAACCGCTCGTACACCG

TACCGAGTGGCGTGGCGACGGCGACGATTAGCGATACCTGGAGGTAGATTATGTAGAATGGGGAGGGTTGTGG

ACTGAGCGGGTAGGTGAATATGATCCGAGACGATGAGGGGTTCGCTTTTGGAGATTATGTCATGAATGTAATG

GGGAAAAGAAAAACCACGGTTGCTTGGAGTTGCATGCCATTGCTTGTGAAT
```

SEQ ID NO: 197
LENGTH: 1917
TYPE: DNA
ORGANISM: M. phaseolina
FEATURE NAME/KEY: CDS
LOCATION: (1)...(1917)

```
atgctctttccctccaaggccctggccctcgtcggcctcttggtcggcgacgcccttgcc
 M   L   F   P   S   K   A   L   A   L   V   G   L   L   V   G   D   A   L   A atcccggccaccacgctgcggaagcgccagagcagcgtcgatacctttatttcgactgag
 I   P   A   T   T   L   R   K   R   Q   S   S   V   D   T   F   I   S   T   E agcccgatcgcatatgccggtgtgctcgccaacattggtgacgatggctcaaaggtcgcc
 S   P   I   A   Y   A   G   V   L   A   N   I   G   D   D   G   S   K   V   A ggcgctgcggccggcatcgtcgtagcgagtccgagcaagagtaaccctgattatttctac
 G   A   A   A   G   I   V   V   A   S   P   S   K   S   N   P   D   Y   F   Y acctggactcgcgatgcatcccttgtcttcaaggcgcttgttgaccacttcatcgccggc
 T   W   T   R   D   A   S   L   V   F   K   A   L   V   D   H   F   I   A   G gattactccctgcaggacgagattgaggatttcatcatctcgcaagcgaagttgcagggc
 D   Y   S   L   Q   D   E   I   E   D   F   I   I   S   Q   A   K   L   Q   G gtgtccaacccgtccggtgacctaagatctggtgctggtcttggcgagcccaagttcaat
 V   S   N   P   S   G   D   L   R   S   G   A   G   L   G   E   P   K   F   N gttgatctgacccaattcaccggtgcttggggaaggccgcaaagagatggaccggccctc
 V   D   L   T   Q   F   T   G   A   W   G   R   P   Q   R   D   G   P   A   L cgcgccacctctatgattgcctacgctcactggttgatcaacaacggttacagcgacacc
 R   A   T   S   M   I   A   Y   A   H   W   L   I   N   N   G   Y   S   D   T gctagagatgttgtgtggcccgtcattaggaacgatctgtcttacgtttctcaatactgg
 A   R   D   V   V   W   P   V   I   R   N   D   L   S   Y   V   S   Q   Y   W aaccagaccggttttgacctttgggaggaggttcaaggctcatccttttcaccattgcg
 N   Q   T   G   F   D   L   W   E   E   V   Q   G   S   S   F   F   T   I   A gtctcgcaccgtgctttagtcgagggcagcaccctcgcttctgcgctcggccagagctgc
 V   S   H   R   A   L   V   E   G   S   T   L   A   S   A   L   G   Q   S   C agctactgtgactctcaggcacctcaaactctctgcttcctgcaaagcttctggacttcc
 S   Y   C   D   S   Q   A   P   Q   T   L   C   F   L   Q   S   F   W   T   S aacggcaactacgtcgtctccaacatcaacaccaacaacggccgaaccggaaaggatgcc
 N   G   N   Y   V   V   S   N   I   N   T   N   N   G   R   T   G   K   D   A aactccatccttgcttccattcacacgttcgatcctgatgcgggttgtgatgacagtacc
 N   S   I   L   A   S   I   H   T   F   D   P   D   A   G   C   D   D   S   T ttccagccctgctctgcacgtgcactggcgaaccacaaggctgtgactgactcttccgc
 F   Q   P   C   S   A   R   A   L   A   N   H   K   A   V   T   D   S   F   R
```

-continued

```
tccatctataacatcaactccggcattgctcagggccgggctgttgctgtgggtagatat
 S  I  Y  N  I  N  S  G  I  A  Q  G  R  A  V  A  V  G  R  Y gctgaggatgtctattacaacggtaaccccctggtacctcaccactctcgctgctgccgag
 A  E  D  V  Y  Y  N  G  N  P  W  Y  L  T  T  L  A  A  A  E cagctctacgatgcgctctacacctggacccgcgagggcactataaccatcacctccgtc
 Q  L  Y  D  A  L  Y  T  W  T  R  E  G  T  I  T  I  T  S  V tccctgcctttcttccgggatatctactcctccgcagcagtcggcacctacgcatccggc
 S  L  P  F  F  R  D  I  Y  S  S  A  A  V  G  T  Y  A  S  G agcgccgcctacacctcaatcctcaatgccgtcaagacctacgccgacggctacgtctcc
 S  A  A  Y  T  S  I  L  N  A  V  K  T  Y  A  D  G  Y  V  S gtcgtccagaagtacacgccctcttccggcgcgttagccgagcagtactcgcgcaacgat
 V  V  Q  K  Y  T  P  S  S  G  A  L  A  E  Q  Y  S  R  N  D ggctcgccgctgtcggccgccgacctgacctggtcctacgccgccttcctgacggccatt
 G  S  P  L  S  A  A  D  L  T  W  S  Y  A  A  F  L  T  A  I gcgcgccgcaactcgatcgtgccggcttcgtggggcggcgagacggccaatgtcgtgccc
 A  R  R  N  S  I  V  P  A  S  W  G  G  E  T  A  N  V  V  P ggcagctgcgtcgctaccagcgcaatcggcacctacgcttcggcaaccaacaccgtcttc
 G  S  C  V  A  T  S  A  I  G  T  Y  A  S  A  T  N  T  V  F cccacttcacaaactagcaacccgggcgccaccaccaccgtccccctaccagctcgacc
 P  T  S  Q  T  S  N  P  G  A  T  T  T  R  P  P  T  S  S  T acgacaaccagggtcaccagcagcaccaccaccacgacaactaaccctacatctgtcgcc
 T  T  T  R  V  T  S  S  T  T  T  T  T  T  N  P  T  S  V  A gtcaccttcaacgtcatcgccaccaccgtcttcggcgagaacatcttccttgctggcagc
 V  T  F  N  V  I  A  T  T  V  F  G  E  N  I  F  L  A  G  S atcgctgcgctgggctcgtgggcccccgcatccgccaaggcccttagcgcggataagtat
 I  A  A  L  G  S  W  A  P  A  S  A  K  A  L  S  A  D  K  Y actagcagtaacaatttgtggtatgtgacggtcagcttggcccctgggactagcttccag
 T  S  S  N  N  L  W  Y  V  T  V  S  L  A  P  G  T  S  F  Q tacaagtacattcgcaagagcagcagcggcgcgtacacctgggagagcgatccgaaccgc
 Y  K  Y  I  R  K  S  S  S  G  A  Y  T  W  E  S  D  P  N  R tcgtacaccgtaccgagtggcgtggcgacggcgacgattagcgatacctggaggtag
 S  Y  T  V  P  S  G  V  A  T  A  T  I  S  D  T  W  R  -

SEQ ID NO: 198
LENGTH: 638
TYPE: PRT
ORGANISM: M. phaseolina
MLFPSKALALVGLLVGDALAIPATTLRKRQSSVDTFISTESPIAYAGVLANIGDDGSKVAGAAAGIVVASPSK

SNPDYFYTWTRDASLVFKALVDHFIAGDYSLQDEIEDFIISQAKLQGVSNPSGDLRSGAGLGEPKFNVDLTQF

TGAWGRPQRDGPALRATSMIAYAHWLINNGYSDTARDVVWPVIRNDLSYVSQYWNQTGFDLWEEVQGSSFFTI

AVSHRALVEGSTLASALGQSCSYCDSQAPQTLCFLQSFWTSNGNYVVSNINTNNGRTGKDANSILASIHTFDP

DAGCDDSTFQPCSARALANHKAVTDSFRSIYNINSGIAQGRAVAVGRYAEDVYYNGNPWYLTTLAAAEQLYDA

LYTWTREGTITITSVSLPFFRDIYSSAAVGTYASGSAAYTSILNAVKTYADGYVSVVQKYTPSSGALAEQYSR

NDGSPLSAADLTWSYAAFLTAIARRNSIVPASWGGETANVVPGSCVATSAIGTYASATNTVFPTSQTSNPGAT

TTRPPTSSTTTTRVTSSTTTTTTNPTSVAVTFNVIATTVFGENIFLAGSIAALGSWAPASAKALSADKYTSSN

NLWYVTVSLAPGTSFQYKYIRKSSSGAYTWESDPNRSYTVPSGVATATISDTWR*

SEQ ID NO: 199
LENGTH: 3281 (including 150 bp 5' UTR and 150 bp 3' UTR)
TYPE: DNA
ORGANISM: M. phaseolina
GGCTCCGCCATACCCGCACGCCGCCGCTGAGCGCGTCCGACCCTCGCCGACATCTCCGCCGGGACACAGACCT

CGCCAGACGCGGTGGCGCCACATCCGTCCATCCCGCTGACCGTCCAAAGCCAGGGAAAGAGCAAGAGCGCAGC

TGAAATGAGCGTTTCCAAGACAGCCGCCCTGCTGTGCTTGGCGGGCGTTGGGCAAGCCCGGCTGACGGATTTC

GTCGACCCTCTCATCGGCACCGTGGGCCCAACGCCGGGCTCCACCATTGCCGGAGGCAATTCGTTCCCCGGAG
```

-continued

```
CCGCGCTGCCGTGGGGAATGGTCAAGGCCGGCATTGACACCAGCTACCTCGGGCTCCCGGACGGCCTCGGGAA
TGACTGCAATGCAGGATACAGCCCGATTGGCAACGTGACTGCCGTGAGCATGACCCACGTCAGCGGCAGCGGC
GGCGTCCCGACATGTAAGCTGCAATGGGCCCGCGTGAAAGAGTGACTGCAGCATTGACATGCGTGCCCAGACG
GCCTGATCTCGCAGATGCCCCTCCTCGGCCCCTTGGACAACATCAACCTGGGCGACAACACGACCTACTGGCA
AAACCGCTCGCTCGCCCTGGAATCGGCCTCGGTCGGCCTCTTCACCACCACCCTCCTCAACGGCATCAAGATC
GAAGTCACCTCGAGCAACCACTCCGCCTTCATCCGCTACACCTTCCCCTCCGACCCTTCGCCAGGCAACCTCT
CCTCGTCCATGCCCACGCTCTCCCAAGACGCCGACGCCTCCGCCGACGCCCACGTCCTCGTGGACCTCACCCA
CGTCCTCCCCGCCTGGGACTGGGACGCGCAGTCGTACTCCCAGAAATACCTGCACGGCGCGCTCACCACCCAC
CAGTCGGCCTCGACCCACCAACCCTCGTACGCCGGCAGCGCCTCCTACTTCGGCGGCTGGTCGCAGCCGGACA
TGCACACGCTGCACTTCTGCGGCAACTTCTCCATCCCCGCGACCTCGCCGCTCGTGCCGTCCAACGCGTACGC
GGCGCAGGGGCCCGGCGGCCGCGTCGACGGCGCCGGCACGCTGAGCTGGCCGTACAACCCGGCCGTGCCGCCG
CTGTGGGAGCAGCGGCCCGTGGTCCGGTCGTACACGGACGTGCGGTCGTCGGCGGGCAGCGGGCTGGGGCTGG
GCGCGCTGTTCAGCTGGACGCGCGACGCGGCCGGCCGCGCCAACGCCAGCGGCCCGGCCGTGGTCGAGGCGAA
GGTGGGCATCTCGTACATCTCCGCGGCCAAGGCGTGCGCGCACGTGGCCGACGAGCTGCCGGCGAGCGTCGCG
TTCGAGGAGGTGGTGGAGCAGGCGCGGGCCGAGTGGGAGGAGCGCGTGCTGGGCGCGGTGCAGCTGGAGGAGG
ACGGCAGTGCGGAGAACGGCAACGCGACGTTGAAGCGGATGCTGTACACGTCGCTGTATCAGACGGGGCTGAT
GCCCACAGACAAGACTGGTGAGAATCCGTGGTGGGAGAGCGATGAGGAGAAGCCGTATTTCGATGATCACTAT
GTGAGTGCTGTCTCGATTTTTTCtTTTTCtTTTTTTTTAgGGGGGAGGGGGGAGGATATGAGATTGGGGATG
GATATGAGATTGGGGATGGATTGGGAGAGGCTTTACTGACCATTCCCCCGGCAGACGCTCTGGGACACGTATC
GCACCACGCTGCCCCTCTACCACCTCCTCTTCACCTCGACCTACACGCGCGTCCTCAAAGGCCTCGTCAACAT
CTTCAAGTACGAAGGCTACCTGCCCGCCGGCCGCACCGCCAACTGGAACGGCCGCGTGCAGGGCGGCACGCAC
GCCGACACCGTCCTCGCCGACGCCTTCGCCAAGTCCGTCATCTCCAACCGCACGCGCGGCCGCGGCGAGCTGG
CCCTCAGCGCCTCCGACTGGAGCGACGCGTACGCCGCGCTCGTCAAGGACGCCGACGTGCCGCCCGCCCGCAA
CGTCGACCCGGTCGCCTTTGACGGCGCGACCAAGGAGGGCCGTGGCGCGCTCGACGAATACCTCACCCTGCAC
TACCTCACCCGCAACCACACGCGCAGCCTCAGCCGCGGCGTCGAGTACCCGCAGAACGACTTCGCCGTGTGGA
GCGTCGCCAGCGGGCTGCAGGCGTTGGGCAACGAGTCGGTCGCTGACGCAGATGTGGCGCGGTACCGCGAGCG
CGCGGGGTGGTGGACGGAGCAGTGGAACCCCTCGGCGAACACGACGCTCGACGGCGTCGGCACCTTCACCGGC
TTCGTGGGCGCGAGGGACGCAGACGGCGCGTGGAATTTCTCGAGCTATGACCCGAGGAGCTGTGGCCGCTGTG
GGTGGGGCAGCGATATCTACGAGGCGAAGGTGTGGGAGACGAGCTTCTCGGCGGCGCCGCACGATATGGCCAA
GGTGGTGGAGCTGATGGGCGGGGATGACGCGTTCTTGGCTCGTCTGGACGCGTCTTTCTTGCCTGGCTTTGGG
ACGAGTGTGGGTGCGAATAATGATGCTGGCTCGGCGCTGTTCAATCCCGGTAGGTTCGAGACAGCGGCAGAAG
GGTGCACGAAGCGGTGACTGACAAGGACGCAGGCAATGAGCCTTCGTTTGCGACGCCTTTCCTGTACAACTAT
GTGCCTGGGAACAACTGGAAGACGGTCAATCAGTCTCGTGCCATCGTCGATGCCTTCTACAGCGACGCCAGAA
ACGGTTATCCCGGAAACATCGACAGCGGCGCGCTGCCGTCCTGGCTCATCTTCAATCTGATCGGGCTGGTAAG
TGCATCACCGACTACTCCTATGCGCGAGGCCACTAGTTCGAAAGAGAATCTGACGTGTCCCCGTAGTATCCCA
TTGCTGGTCAGCCTCTCTATCTCCTTGGCGCCCCTCGCTTTTCGTCTCTGACCCTGCGCCTATTCCCTGGCAC
GGAGCAGATGACGTCGCTGCAAGTCAAGGCCACCAACCTGTCTGCTACGACCTTCTACCCCCAACGCGTGACG
CTTAATGGCGCTGCACTTGATCGGGCGTGGTTGCACCATTCGGAGCTGGTTGATGGCGGAGAGCTGGTTTTCG
AGATGGGCGCTGAGCCTGCGAAGTGGGATACCGGGGAGAGGCCGTGGTCGCTGAGCCCATGGTGAAGGGAACA
AATGAAGAAAGATACGTAATTCACATGGGCGGAGATCCGTCCTCCTTGCCACGTGACCCGCTTTGGAACGCG
TTTGGTAATGCAGGGTCCTCAGTGGCCGCTATGTACATTTACCACACGAATTAATCAACCACTTATCCC
```

-continued

SEQ ID NO: 200
LENGTH: 2670
TYPE: DNA
ORGANISM: M. phaseolina
FEATURE NAME/KEY: CDS
LOCATION: (1)...(2670)

```
atgagcgtttccaagacagccgccctgctgtgcttggcgggcgttgggcaagcccggctg
 M   S   V   S   K   T   A   A   L   L   C   L   A   G   V   G   Q   A   R   L acggatttcgtcgaccctctcatcggcaccgtgggcccaacgccgggctccaccattgcc
 T   D   F   V   D   P   L   I   G   T   V   G   P   T   P   G   S   T   I   A ggaggcaattcgttccccggagccgcgctgccgtggggaatggtcaaggccggcattgac
 G   G   N   S   F   P   G   A   A   L   P   W   G   M   V   K   A   G   I   D accagctacctcgggctcccggacggcctcgggaatgactgcaatgcaggatacagcccg
 T   S   Y   L   G   L   P   D   G   L   G   N   D   C   N   A   G   Y   S   P attggcaacgtgactgccgtgagcatgacccacgtcagcggcagcggcggcgtcccgaca
 I   G   N   V   T   A   V   S   M   T   H   V   S   G   S   G   G   V   P   T tacggcctgatctcgcagatgcccctcctcggcccccttggacaacatcaacctgggcgac
 Y   G   L   I   S   Q   M   P   L   L   G   P   L   D   N   I   N   L   G   D aacacgacctactggcaaaaccgctcgctcgccctggaatcggcctcggtcggcctcttc
 N   T   T   Y   W   Q   N   R   S   L   A   L   E   S   A   S   V   G   L   F accaccaccctcctcaacggcatcaagatcgaagtcacctcgagcaaccactccgccttc
 T   T   T   L   L   N   G   I   K   I   E   V   T   S   S   N   H   S   A   F atccgctacaccttcccctccgacccttcgccaggcaacctctcctcgtccatgccacg
 I   R   Y   T   F   P   S   D   P   S   P   G   N   L   S   S   S   M   P   T ctctcccaagacgccgacgcctccgccgacgcccacgtcctcgtggacctcacccacgtc
 L   S   Q   D   A   D   A   S   A   D   A   H   V   L   V   D   L   T   H   V ctccccgcctgggactgggacgcgcagtcgtactcccagaaatacctgcacggcgcgctc
 L   P   A   W   D   W   D   A   Q   S   Y   S   Q   K   Y   L   H   G   A   L accacccaccagtcggcctcgacccaccaaccctcgtacgccggcagcgcctcctacttc
 T   T   H   Q   S   A   S   T   H   Q   P   S   Y   A   G   S   A   S   Y   F ggcggctggtcgcagccggacatgcacacgctgcacttctgcggcaacttctccatcccc
 G   G   W   S   Q   P   D   M   H   T   L   H   F   C   G   N   F   S   I   P gcgacctcgccgctcgtgccgtccaacgcgtacgcggcgcaggggcccggcggccgcgtc
 A   T   S   P   L   V   P   S   N   A   Y   A   A   Q   G   P   G   G   R   V gacggcgccggcacgctgagctggccgtacaacccggccgtgccgccgctgtgggagcag
 D   G   A   G   T   L   S   W   P   Y   N   P   A   V   P   P   L   W   E   Q cggcccgtggtccggtcgtacacggacgtgcggtcgtcggcgggcagcgggctggggctg
 R   P   V   V   R   S   Y   T   D   V   R   S   S   A   G   S   G   L   G   L ggcgcgctgttcagctggacgcgcgacgcggccggccgcgccaacgccagcggcccggcc
 G   A   L   F   S   W   T   R   D   A   A   G   R   A   N   A   S   G   P   A gtggtcgaggcgaaggtgggcatctcgtacatctccgcggccaaggcgtgcgcgcacgtg
 V   V   E   A   K   V   G   I   S   Y   I   S   A   A   K   A   C   A   H   V gccgacgagctgccggcgagcgtcgcgttcgaggaggtggtggagcaggcgcgggccgag
 A   D   E   L   P   A   S   V   A   F   E   E   V   V   E   Q   A   R   A   E tgggaggagcgcgtgctgggcgcggtgcagctggaggaggacggcagtgcggagaacggc
 W   E   E   R   V   L   G   A   V   Q   L   E   E   D   G   S   A   E   N   G aacgcgacgttgaagcggatgctgtacacgtcgctgtatcagacggggctgatgccaca
 N   A   T   L   K   R   M   L   Y   T   S   L   Y   Q   T   G   L   M   P   T gacaagactggtgagaatccgtggtgggagagcgatgaggagaagccgtatttcgatgat
 D   K   T   G   E   N   P   W   W   E   S   D   E   E   K   P   Y   F   D   D cactatacgctctgggacacgtatcgcaccacgctgcccctctaccacctcctcttcacc
 H   Y   T   L   W   D   T   Y   R   T   T   L   P   L   Y   H   L   L   F   T tcgacctacacgcgcgtcctcaaaggcctcgtcaacatcttcaagtacgaaggctacctg
 S   T   Y   T   R   V   L   K   G   L   V   N   I   F   K   Y   E   G   Y   L cccgccggccgcaccgccaactggaacggccgcgtgcagggcggcacgcacgccgacacc
 P   A   G   R   T   A   N   W   N   G   R   V   Q   G   G   T   H   A   D   T
```

```
gtcctcgccgacgccttcgccaagtccgtcatctccaaccgcacgcgcggccgcggcgag
 V  L  A  D  A  F  A  K  S  V  I  S  N  R  T  R  G  R  G  E ctggccctcagcgcctccgactggagcgacgcgtacgccgcgctcgtcaaggacgccgac
 L  A  L  S  A  S  D  W  S  D  A  Y  A  A  L  V  K  D  A  D gtgccgccgcccgcaacgtcgacccggtcgcctttgacggcgcgaccaaggagggccgt
 V  P  P  A  R  N  V  D  P  V  A  F  D  G  A  T  K  E  G  R ggcgcgctcgacgaatacctcaccctgcactacctcacccgcaaccacacgcgcagcctc
 G  A  L  D  E  Y  L  T  L  H  Y  L  T  R  N  H  T  R  S  L agccgcggcgtcgagtacccgcagaacgacttcgccgtgtggagcgtcgccagcgggctg
 S  R  G  V  E  Y  P  Q  N  D  F  A  V  W  S  V  A  S  G  L caggcgttgggcaacgagtcggtcgctgacgcagatgtggcgcggtaccgcgagcgcgcg
 Q  A  L  G  N  E  S  V  A  D  A  D  V  A  R  Y  R  E  R  A gggtggtggacggagcagtggaacccctcggcaacacgacgctcgacggcgtcggcacc
 G  W  W  T  E  Q  W  N  P  S  A  N  T  T  L  D  G  V  G  T ttcaccggcttcgtgggcgcgagggacgcagacggcgcgtggaatttctcgagctatgac
 F  T  G  F  V  G  A  R  D  A  D  G  A  W  N  F  S  S  Y  D ccgaggagctgtggccgctgtgggtggggcagcgatatctacgaggcgaaggtgtgggag
 P  R  S  C  G  R  C  G  W  G  S  D  I  Y  E  A  K  V  W  E acgagcttctcggcggcgccgcacgatatggccaaggtggtggagctgatgggcggggat
 T  S  F  S  A  A  P  H  D  M  A  K  V  V  E  L  M  G  G  D gacgcgttcttggctcgtctggacgcgtctttcttgcctggctttgggacgagtgtgggt
 D  A  F  L  A  R  L  D  A  S  F  L  P  G  F  G  T  S  V  G gcgaataatgatgctggctcggcgctgttcaatcccggcaatgagccttcgtttgcgacg
 A  N  N  D  A  G  S  A  L  F  N  P  G  N  E  P  S  F  A  T cctttcctgtacaactatgtgcctgggaacaactggaagacggtcaatcagtctcgtgcc
 P  F  L  Y  N  Y  V  P  G  N  N  W  K  T  V  N  Q  S  R  A atcgtcgatgccttctacagcgacgccagaaacggttatcccggaaacatcgacagcggc
 I  V  D  A  F  Y  S  D  A  R  N  G  Y  P  G  N  I  D  S  G gcgctgccgtcctggctcatcttcaatctgatcgggctgtatcccattgctggtcagcct
 A  L  P  S  W  L  I  F  N  L  I  G  L  Y  P  I  A  G  Q  P ctctatctccttggcgcccctcgcttttcgtctctgaccctgcgcctattccctggcacg
 L  Y  L  L  G  A  P  R  F  S  S  L  T  L  R  L  F  P  G  T gagcagatgacgtcgctgcaagtcaaggccaccaacctgtctgctacgaccttctacccc
 E  Q  M  T  S  L  Q  V  K  A  T  N  L  S  A  T  T  F  Y  P caacgcgtgacgcttaatggcgctgcacttgatcgggcgtggttgcaccattcggagctg
 Q  R  V  T  L  N  G  A  A  L  D  R  A  W  L  H  H  S  E  L gttgatggcggagagctggttttcgagatgggcgctgagcctgcgaagtgggataccggg
 V  D  G  G  E  L  V  F  E  M  G  A  E  P  A  K  W  D  T  G gagaggccgtggtcgctgagcccatggtga
 E  R  P  W  S  L  S  P  W  -

SEQ ID NO: 201
LENGTH: 889
TYPE: PRT
ORGANISM: M. phaseolina
MSVSKTAALLCLAGVGQARLTDFVDPLIGTVGPTPGSTIAGGNSFPGAALPWGMVKAGIDTSYLGLPDGLGND

CNAGYSPIGNVTAVSMTHVSGSGGVPTYGLISQMPLLGPLDNINLGDNTTYWQNRSLALESASVGLFTTTLLN

GIKIEVTSSNHSAFIRYTFPSDPSPGNLSSSMPTLSQDADASADAHVLVDLTHVLPAWDWDAQSYSQKYLHGA

LTTHQSASTHQPSYAGSASYFGGWSQPDMHTLHFCGNFSIPATSPLVPSNAYAAQGPGGRVDGAGTLSWPYNP

AVPPLWEQRPVVRSYTDVRSSAGSGLGLGALFSWTRDAAGRANASGPAVVEAKVGISYISAAKACAHVADELP

ASVAFEEVVEQARAEWEERVLGAVQLEEDGSAENGNATLKRMLYTSLYQTGLMPTDKTGENPWWESDEEKPYF

DDHYTLWDTYRTTLPLYHLLFTSTYTRVLKGLVNIFKYEGYLPAGRTANWNGRVQGGTHADTVLADAFAKSVI

SNRTRGRGELALSASDWSDAYAALVKDADVPPARNVDPVAFDGATKEGRGALDEYLTLHYLTRNHTRSLSRGV

EYPQNDFAVWSVASGLQALGNESVADADVARYRERAGWWTEQWNPSANTTLDGVGTFTGFVGARDADGAWNFS
```

SYDPRSCGRCGWGSDIYEAKVWETSFSAAPHDMAKVVELMGGDDAFLARLDASFLPGFGTSVGANNDAGSALF

NPGNEPSFATPFLYNYVPGNNWKTVNQSRAIVDAFYSDARNGYPGNIDSGALPSWLIFNLIGLYPIAGQPLYL

LGAPRFSSLTLRLFPGTEQMTSLQVKATNLSATTFYPQRVTLNGAALDRAWLHHSELVDGGELVFEMGAEPAK

WDTGERPWSLSPW*

SEQ ID NO: 202
LENGTH: 3322 (including 150 bp 5' UTR and 150 bp 3' UTR)
TYPE: DNA
ORGANISM: M. phaseolina

CCATGCGAATTGGCTCTTAAGCTTATAAGCAAGGGACTTCGGACGGAATAAATTGAACCGACTACCGGATTGA

AAGGTCTAGCTGGCTTTTTGCTCCGAGAAAAATCCTATGGTTGAATTTGCCACGACGCGAATTGATCGTCAGT

CAAGATGAGAACAAGCCCACCTTGCCTCTCATTGCTTTTAGTTCTCCTCGCAAAGATAGCAAATACTCAGGAT

GACCTGGCCGCCTACGTCGACCCCATGATCGGTACCTCCGGCACTGTTCCCGGCACCGCCTACAACGCCGGGA

ACGTCTTCCCCGGCGCTGCCGTCCCCTTTGGGGCAGTGAAATGCGGAATAGAGTAAGCGTGGTGTTCACCTTT

CATCTCTCTCTCTCTCTCGCTCGCTCGCTTCAACAAAAAGCCCCTCTAGGCAATTACTAAAAACCTCACC

AGCACAACCGTGTGAGTCTAACCAACCGCTCTTGTCTGAACCACCTCGACCACGCAGTTCAAGACAATTGACC

GCAAAACGGGCACACCAGTTTCAACAACAGCTTCAACGCCAACGGTGGCTACACGCCCGACGGCAACGTTACA

GCCATCTCGCTTCTGCACGAGAGCGGCACCGGCGGTGCGGTCAAGTACGGCGTCGTGGCGCAGATGCCGCTGG

CGTCGCTGGCCGGCGTGAACGTACTCGATAACTTGACGTACGCGCAGCGGCGGGTCGGGCAGGATGAGGCGAG

TCCGGGGTACTTCAAGACGGAGCTGGGGAACGTGAGTAAACTTTCTTTCTTTTCTTTCCCTCTCTTGTTATGA

CGCATGGGTCCAAGATAATGAGTTTGCGGCGATTATAGGGCGTGACGGCGGAGATGTCGGCAACGCAGCATGT

GGGGGTCATGAAATACAGCTACCAGACAGAGGGGGAGAGGTATGTGCTGGTGGATGTATCGCATTACCTCCCG

ACGAACGACGAGGTGGCGTTCGCGCAGTTCTACAGCAACGGACGCCTGGATCTGGAAGAGGATGGGTCGTACA

GCGGGTACGGGGTGTGGAGGTAAAGTCTTATCGTCCTGAAATACAAACACCTCCATTAACACGAAAACCCAGG

GGCGGCTGGAACGGTGGTCAGCAATCCCATTCGCTCCACGATCCCACGCGAGGGCAACATCACCCTGACATTT

CCTCAAACAGATCCCAACTACCAAGTCCACTTTTGCGGCCGCTTCGACACCGCCCCGACCACGGCCACCCTCT

TCTCCGGCCCCTACACAGACCCCTTCTGGCCCAACAGCACCGCCACCGGCGACGCCGTCGTCCCCACTTGGCA

CAACGCTTCCACCTCCCTCGCCGGCGCCCGCCCGGCTACAGCACCGCCAACCGCATCGGCGCGCTCTTCGCC

TTCCCGCCCAACACCACCACGCTCACCTCCAAAGTCGGCGTTTCCTGGATCTCCGTCGCCAAAGCGTGCCAGT

TTGCCGACGAGGAGGTCGTGTCCTGGGACCTCGGCGCGACCGCGCAAGCCGCGCGCGCGATGTGGAACGACGA

CGTGCTGGCGCGGATCAAGACGGGCGACAGGGCGAACGCGACGAGGCTGACGATGCTGTATTCGGCGCTTTAC

AAGGCGCATCTGATTCCGAGGTGAGTGAGGGGATTCGTTTTGTTGGTGCCGCAGAGGGTTGCGAGGTCGGCGT

TGACGGCGGAGTAGCGACCGCACCGGCGAGAATCCGCACTGGACGTCGGAGGAGCCGTATTATGACGACTTCT

ACACGCTTTGGGATACTTTCAGGTGCTTGAATAGTCTGTGGTTGCTGCTCGAGCCGGCGAGGGCGGCGGGGAT

GGTGCGCTCGTTGGTGGATATTTGGAGACATGAGCGATTTATGCCGGATGGGCGCAGTAGTAACTACAACGGC

AGGGTGAGTGTATCACTGCAGACAATTGGATGGACGTTAACAGGATCCCCCAGGTACAAGGGGGCAGCAACGC

GGACAACGTCCTCGCGGACGCGTTCGTCAAAGGGCTCGAGTACGGAATCAACTGGACGGACGCGTATGCCGCC

ATGAAGACTGATGCAGAAGTGGTGCCGTATAACACGTTCGATACGGAGGACCCGACGCAGAGCACGAAGGAGG

GCCGCGGTGCGCTGCGAGACTGGCTGGACTACGGTTTCGTGACGCCGAACTACGGACGCTCCGTCAGCAAGAC

GGTCGAGTACGCACTGAACGACTTTGCTCTCAGCCAGGTAGCAAAAGACCTCGCGCCAGACGACTACCCGAAG

TACTTGCAGCGATCAGCGTAAGTTCCCTCCCAGCACCCAGGTCGGCTACATCATGGCGTTTTGTTAAATAACA

CAACACCCCATCGCAGCGGCTGGCAAAAGATCTGGTCCGCCAACACCACCTCCCTCAACCACACCGGGTTTCT

TGCGCCACTCTTCCCCAACAACAGCATCCCGGCCTCCCTCCAACCCTACGACCCCACCACTTGCGGCGGCTGC

GAATGGTCCTCCATCGCCTACGAAGCCACGCCGTGGGAATACAGCTGGACGATCCCGTTCGACATGCAGACGC

```
TTATCACGCTCATGGGCGACGCCGCCGCCGCCGAGGACCGGCTCGACACCATGTTCGTGCCGGGCTTGCGGCC

GGGGTCGGTGGGGTCGGGCGGCTCGAACACGAACGGCGACGCGCTGTTCAACCCGGGCAACGAGCCGAGCTTC

ACCACGCCATTCTTGTACAACTACTTCGCACGGCGCCAGCACCGCAGCGTGTTGCGCGCGCGGCAGGTCGTCA

ACCAGTACTACGGCGTCTCGCCGTCGGGCCTGCCGGGGAATAGCGATGGCGGGGCGCTGGATAGCTGGTTGGT

GTGGAATCTGCTCGGGCTGTATCCGGTGGTGACGCAGCCGGTGTACCTCATCTTGTCGCCGTGGTTTGCGGAT

CTGACGATTCGGATGCCGAGTCCGGAGGGGCCGGAGGGGGTGGACAGGTGGTTAAATGTGACGGCCGAGGGGC

TGGGGGAGGAGAGTTTCTACGTGCAGAGCCTGAAGGTGAATGGGGTGAGTTGGGATAAGAGTTGGCTGAGCCA

CGAGGATATCAAGGCCGGGGCGACGCTAGAGTTCGTGCTGGGCGCAGAGCCGGTGGAATGGGACACGGGCGAG

TTACCGCCCAGCCCGGGCCATGTCGAGCTGTGAGCGCGGAACTGGATGGCTTTCGGTCGAGCAAGTTTTCCCA

GCGGAAGGTAAAAGGCGTGGCTGAAGGGTGACGAGGCTCAGTTGAAGGCAGTTTCGATCTGTTGAGTTTGAGG

CGTGGCGGCTTGGTTGCCCGTTGGTCACCCGATGGTT
```

SEQ ID NO: 203
LENGTH: 2361
TYPE: DNA
ORGANISM: *M. phaseolina*
FEATURE NAME/KEY: CDS
LOCATION: (1)...(2361)

```
atgagaacaagcccaccttgcctctcattgcttttagttctcctcgcaaagatagcaaat
 M   R   T   S   P   P   C   L   S   L   L   L   V   L   L   A   K   I   A   N actcaggatgacctggccgcctacgtcgacccatgatcggtacctccggcactgttccc
 T   Q   D   D   L   A   A   Y   V   D   P   M   I   G   T   S   G   T   V   P ggcaccgcctacaacgccgggaacgtcttccccggcgctgccgtcccctttggggcagtg
 G   T   A   Y   N   A   G   N   V   F   P   G   A   A   V   P   F   G   A   V aaatgcggaatagacacaaccgttttcaacaacagcttcaacgccaacggtggctacacg
 K   C   G   I   D   T   T   V   F   N   N   S   F   N   A   N   G   G   Y   T cccgacggcaacgttacagccatctcgcttctgcacgagagcggcaccggcggtgcggtc
 P   D   G   N   V   T   A   I   S   L   L   H   E   S   G   T   G   G   A   V aagtacggcgtcgtggcgcagatgccgctggcgtcgctggccggcgtgaacgtactcgat
 K   Y   G   V   V   A   Q   M   P   L   A   S   L   A   G   V   N   V   L   D aacttgacgtacgcgcagcggcgggtcgggcaggatgaggcgagtccggggtacttcaag
 N   L   T   Y   A   Q   R   R   V   G   Q   D   E   A   S   P   G   Y   F   K acggagctggggaacggcgtgacggcggagatgtcggcaacgcagcatgtggggggtcatg
 T   E   L   G   N   G   V   T   A   E   M   S   A   T   Q   H   V   G   V   M aaatacagctaccagacagagggggagaggtatgtgctggtggatgtatcgcattacctc
 K   Y   S   Y   Q   T   E   G   E   R   Y   V   L   V   D   V   S   H   Y   L ccgacgaacgacgaggtggcgttcgcgcagttctacagcaacggacgcctggatctggaa
 P   T   N   D   E   V   A   F   A   Q   F   Y   S   N   G   R   L   D   L   E gaggatgggtcgtacagcgggggcggctggaacggtgatcccaactaccaagtccacttt
 E   D   G   S   Y   S   G   G   G   W   N   G   D   P   N   Y   Q   V   H   F tgcggccgcttcgacaccgccccgaccacggccaccctcttctccggcccctacacagac
 C   G   R   F   D   T   A   P   T   T   A   L   F   S   G   P   Y   T   D cccttctggcccaacagcaccgccaccggcgacgccgtcgtcccacttggcacaacgct
 P   F   W   P   N   S   T   A   T   G   D   A   V   V   P   T   W   H   N   A tccacctccctcgccggcggcccgccggctacagcaccgccaaccgcatcggcgcgctc
 S   T   S   L   A   G   G   P   P   G   Y   S   T   A   N   R   I   G   A   L ttcgccttcccgcccaacaccaccacgctcacctccaaagtcggcgtttcctggatctcc
 F   A   F   P   P   N   T   T   T   L   T   S   K   V   G   V   S   W   I   S gtcgccaaagcgtgccagtttgccgacgaggaggtcgtgtcctgggacctcggcgcgacc
 V   A   K   A   C   Q   F   A   D   E   E   V   V   S   W   D   L   G   A   T gcgcaagccgcgcgcgcgatgtggaacgacgacgtgctggcgcggatcaagacgggcgac
 A   Q   A   A   R   A   M   W   N   D   D   V   L   A   R   I   K   T   G   D agggcgaacgcgacgaggctgacgatgctgtattcggcgctttacaaggcgcatctgatt
 R   A   N   A   T   R   L   T   M   L   Y   S   A   L   Y   K   A   H   L   I
```

```
ccgagcgaccgcaccggcgagaatccgcactggacgtcggaggagccgtattatgacgac
 P  S  D  R  T  G  E  N  P  H  W  T  S  E  E  P  Y  Y  D  D ttctacacgctttgggatactttcaggtgcttgaatagtctgtggttgctgctcgagccg
 F  Y  T  L  W  D  T  F  R  C  L  N  S  L  W  L  L  L  E  P gcgaggcggcggggatggtgcgctcgttggtggatatttggagacatgagcgatttatg
 A  R  A  A  G  M  V  R  S  L  V  D  I  W  R  H  E  R  F  M ccggatgggcgcagtagtaactacaacggcagggtacaaggggggcagcaacgcggacaac
 P  D  G  R  S  S  N  Y  N  G  R  V  Q  G  G  S  N  A  D  N gtcctcgcggacgcgttcgtcaaagggctcgagtacggaatcaactggacggacgcgtat
 V  L  A  D  A  F  V  K  G  L  E  Y  G  I  N  W  T  D  A  Y gccgccatgaagactgatgcagaagtggtgccgtataacacgttcgatacggaggacccg
 A  A  M  K  T  D  A  E  V  V  P  Y  N  T  F  D  T  E  D  P acgcagagcacgaaggagggccgcggtgcgctgcgagactggctggactacggtttcgtg
 T  Q  S  T  K  E  G  R  G  A  L  R  D  W  L  D  Y  G  F  V acgccgaactacggacgctccgtcagcaagacggtcgagtacgcactgaacgactttgct
 T  P  N  Y  G  R  S  V  S  K  T  V  E  Y  A  L  N  D  F  A ctcagccaggtagcaaaagacctcgcgccagacgactacccgaagtacttgcagcgatca
 L  S  Q  V  A  K  D  L  A  P  D  D  Y  P  K  Y  L  Q  R  S gccatcccggcctcctccaaccctacgaccccaccacttgcggcggctgcgaatggtcc
 A  I  P  A  S  L  Q  P  Y  D  P  T  T  C  G  G  C  E  W  S tccatcgcctacgaagccacgccgtgggaatacagctggacgatcccgttcgacatgcag
 S  I  A  Y  E  A  T  P  W  E  Y  S  W  T  I  P  F  D  M  Q acgcttatcacgctcatgggcgacgccgccgccgccgaggaccggctcgacaccatgttc
 T  L  I  T  L  M  G  D  A  A  A  A  E  D  R  L  D  T  M  F gtgccgggcttgcggccggggtcggtggggtcggggcggctcgaacacgaacggcgacgcg
 V  P  G  L  R  P  G  S  V  G  S  G  G  S  N  T  N  G  D  A ctgttcaacccgggcaacgagccgagcttcaccacgccattcttgtacaactacttcgca
 L  F  N  P  G  N  E  P  S  F  T  T  P  F  L  Y  N  Y  F  A cggcgccagcaccgcagcgtgttgcgcgcgcggcaggtcgtcaaccagtactacggcgtc
 R  R  Q  H  R  S  V  L  R  A  R  Q  V  V  N  Q  Y  Y  G  V tcgccgtcgggcctgccggggaatagcgatggcggggcgctggatagctggttggtgtgg
 S  P  S  G  L  P  G  N  S  D  G  G  A  L  D  S  W  L  V  W aatctgctcgggctgtatccggtggtgacgcagccggtgtacctcatcttgtcgccgtgg
 N  L  L  G  L  Y  P  V  V  T  Q  P  V  Y  L  I  L  S  P  W tttgcggatctgacgattcggatgccgagtccggaggggccggaggggtggacaggtgg
 F  A  D  L  T  I  R  M  P  S  P  E  G  P  E  G  V  D  R  W ttaaatgtgacggccgaggggctgggggaggagagtttctacgtgcagagcctgaaggtg
 L  N  V  T  A  E  G  L  G  E  E  S  F  Y  V  Q  S  L  K  V aatggggtgagtttgggataagagttggctgagccacgaggatatcaaggccggggcgacg
 N  G  V  S  W  D  K  S  W  L  S  H  E  D  I  K  A  G  A  T ctagagttcgtgctgggcgcagagccggtggaatgggacacgggcgagttaccgcccagc
 L  E  F  V  L  G  A  E  P  V  E  W  D  T  G  E  L  P  P  S ccgggccatgtcgagctgtga
 P  G  H  V  E  L  -

SEQ ID NO: 204
LENGTH: 786
TYPE: PRT
ORGANISM: M. phaseolina
```

MRTSPPCLSLLLVLLAKIANTQDDLAAYVDPMIGTSGTVPGTAYNAGNVFPGAAVPFGAVKCGIDTTVFNNSF

NANGGYTPDGNVTAISLLHESGTGGAVKYGVVAQMPLASLAGVNVLDNLTYAQRRVGQDEASPGYFKTELGNG

VTAEMSATQHVGVMKYSYQTEGERYVLVDVSHYLPTNDEVAFAQFYSNGRLDLEEDGSYSGGWNGDPNYQVH

FCGRFDTAPTTATLFSGPYTDPFWPNSTATGDAVVPTWHNASTSLAGGPPGYSTANRIGALFAFPPNTTTLTS

KVGVSWISVAKACQFADEEVVSWDLGATAQAARAMWNDDVLARIKTGDRANATRLTMLYSALYKAHLIPSDRT

GENPHWTSEEPYYDDFYTLWDTFRCLNSLWLLLEPARAAGMVRSLVDIWRHERFMPDGRSSNYNGRVQGGSNA

-continued

DNVLADAFVKGLEYGINWTDAYAAMKTDAEVVPYNTFDTEDPTQSTKEGRGALRDWLDYGFVTPNYGRSVSKT

VEYALNDFALSQVAKDLAPDDYPKYLQRSAIPASLQPYDPTTCGGCEWSSIAYEATPWEYSWTIPFDMQTLIT

LMGDAAAAEDRLDTMFVPGLRPGSVGSGGSNTNGDALFNPGNEPSFTTPFLYNYFARRQHRSVLRARQVVNQY

YGVSPSGLPGNSDGGALDSWLVWNLLGLYPVVTQPVYLILSPWFADLTIRMPSPEGPEGVDRWLNVTAEGLGE

ESFYVQSLKVNGVSWDKSWLSHEDIKAGATLEFVLGAEPVEWDTGELPPSPGHVEL*

SEQ ID NO: 205
LENGTH: 2921 (including 150 bp 5' UTR and 150 bp 3' UTR)
TYPE: DNA
ORGANISM: M. phaseolina

CTCCTTCCGTTTTGGGCCGGGAGCGTGCGGGGCAGCAAGATTTACCTCCCGGCTCAGCCAAGCGTAGCATGAC

TGTCGCACAGATGTCACCCTCATCAAACGCGTGAAACAAAATGGTCTTGTGCGCCCGGCTTCTTGGCCGCCTC

TCGAATGAACGCCATGTTCGGCTTCCTCATTGCACTCGCTTGCGCCGCCTCGCCTATCGCTGCTCAGGCGGGC

GGCGATTTCGACATCTTGGATTTTGTGGATCCGCTAATTGGGTCGAATGGCGGAGGGAACGTCTTCTGTGGCG

CAACTCTGCCGTATGGGTTGGTGCGTTGTACCACCTCCCTGTGCTATGGGCAGGACATCACCATGCACGTGGT

GTCCGGCAACTTCCCAAGCATCGCTTCGCCTGGCTCTGTGCTCTGTGCGTGTCCCGCTAAACGGCTGAGATAC

AGGCAAAAGCATCTGCCGATGTCGATGGCCAGAACACAGCCGGCTTCTCGACAGATGGCAGCAATGTCATCGG

CTTTTCGAGCTTGCACGACTCTGGAACCGGCGGCAATCCATCCCTAGGCAACTTTCCCCTGATGCCGCAGTTG

TGCGCGGAAAATGACATTAACAACTGCTCCTTCTCCAAGCAAGCGCGCGCCACGCCTTACCGCAACGATTCCA

TCGTGGCCAGGCCCGGGTATTTTGCGTTGACTCTGGACAACGGCATAAGCGCAGAAATGACCGTATCCCAGCA

CGCTGCGTTGCATAATTTCAAATTCCCAGACGTCAACGCCAGCGACGGCACGCAACTGGTCCCCATGGTCCTG

CTGGATCTCACGGATCTGTGGGACAGTCGCCAGAATGGAACCTTCCAGGCGCAAGGGACCAGGATGACCGGAA

ACGGGACGTTTCTGCCGAGCTTTGGAGCGGGATCCTACGAAGTGCACTTCTGTGTGGATTTCTTCGGCCACAC

CGGCCCCGTCTACGACAGTGGCATCTGGGTCAACGAAAGGGGCGGTTCGGATCAAAAGGAGATATTCGTCACC

AGGGGTTTCAACAACTTCTATCTCCAAGCTGGCGGATTTGTGCGGCTCCTCGCAGAAGCCAACAGAACCATCA

CCGCGAGGGTGGGCTTGAGCTATATCAGCGCCCAGAAGGCGTGCCGGAACGCAGAGGCGGAGATTCCAAGCCC

GCTGTCGGATTTCAATCGTCTTAGAGCAGCTGCCGAGGATGCTTGGAGGGACAAACTGAGCCCGATAACCCTA

GACGCCGGTGAGGTCAGCCAGGACTTGCAGAAGAACTTCTGGAGCTCGATTTACAGGACAATGATCTCACCCC

AGGACTATACGGGCGAGAATCCACGCTGGAACACGTCAGTTTATTTCGACTCGTTCTATTGCCTGTGGGACCA

GTTCAGGTCTCAGCTGCCCCTGCTCACCATTCTGGATCCGACGGCTTATTCAGACATGCTGAACAGTCTCCTG

TTCATCTACCAGAATGAGGGTTGGCTGCCGGATTGCCGGATGAGTTTAAGCAAGGGCTGGACTCAGGGAGGCT

CGAATGCAGATGTGGTACTGGTGGATGCTTATTTCAAGAACGTCACCGGTGTGGACTGGGACCTTGCCTGGAA

GGCCGTTGTGAATGATGCAGAAAATGAGCCGCTGGAATGGTCAAAGGAAGGTAGAGGAGGCCTGCTGTCCTGG

AAGAACCTCCACTATATTCCGGCCCTTGATTTTGACTATCTTGGTTTCGGGACTAACTCGAGAAGCATCTCAC

GCACCTTGGAATACGCTTACAACGATTATTGCATCGGAGCGCTTGGAAGAGCACTGGCCAAGGATGGATATGA

GACGTATTTGGCCCGGGGCAACAACTGGAAGAACCTCTTCAAAGAGGATCAAACTTCGATTATCAACGGCACA

GATTCAGGCTTCGTCGGCTTCTTCCAACCCAAGTACCTGAACGCAACTTGGGGTTTCCAGGATCCGATCTCGT

GCAGCCCTGTGGCGGGGTTCTGTTCCCTGACAAGCAACCCTTCGGAGACGTTTGAATCAAGTATCTGGGAGTA

TCAGTTGTAAGTCTCGAGCGGAGAACAAGTGCGGAACTGCAACCTTACTGATACTGCTCCAAGTTTCGTACCC

CAAGACATGGAAACGCTCATTGCAAGACTTGGTGGAGATCAAAGATTTGTCGACCGGCTGGACTATTTCCACG

AGTCGCCCCTCGTAGATATAGGAAATGAGCCGGTGTTCTTGAGCGTCTTCGAATACCATTACGCAGGGAGGCC

TGCCCTTTCAGCACGACGCTCTCATTCTTACATCCCGTCTCGCTTCAACACTTCCTACAGTGGCCTACCAGGA

AATGATGATGTGAGTACCGTGAATCTGGGTGAGCTACATATGTTTGAACTGACGCGTTCCCAGAGTGGCGCAA

TGGGTTCTTATGCAGCTTTCAACATGATGGGCCTCTTTCCCAACCCTGGCCAGAACGTCTACTTTATTATTCC

```
GCCGTATTTCCCGAGAATGCAAGTGCGGCATCCAGTAACGAATCGGACGGCGACGATACGTGCGGATAATTTC

GACGCCGCTTACAGCAACATCTACATCCAGAATGCGACGCTGAATGGAGAGCCGTACACCAAAAACTGGATTG

GGCATGAGTTCTTCACGCAGGGCGGCGAGCTGGTCCTGACCCTAGGTAGCGAGGAGAGCCAGTGGGGAACAGC

TGTAGAGGATCGACCGCCTTCGGAGACTGGAGGAAGTCGGACTGAGGAGCGGTCTTGGAGCGGCCTTTAGTAG

GGCGGCGACCGCTGCGCAAACAGCCTGACAATGAAGGCGATGATTCAGCTTCTGTTTCATTGGACTCCATCAG

GCGTGGACTGAAGTCACTTGCTGGCCAAGTTCCGTAGCTGATCCATTGGGACTTGAGTCGCAATCCACACGGCG
```

```
SEQ ID NO: 206
LENGTH: 2382
TYPE: DNA
ORGANISM: M. phaseolina
FEATURE NAME/KEY: CDS
LOCATION: (1)...(2382)
atgaacgccatgttcggcttcctcattgcactcgcttgcgccgcctcgcctatcgctgct
 M  N  A  M  F  G  F  L  I  A  L  A  C  A  A  S  P  I  A  A caggcgggcggcgatttcgacatcttggattttgtggatccgctaattgggtcgaatggc
 Q  A  G  G  D  F  D  I  L  D  F  V  D  P  L  I  G  S  N  G ggagggaacgtcttctgtggcgcaactctgccgtatgggttggcaaaagcatctgccgat
 G  G  N  V  F  C  G  A  T  L  P  Y  G  L  A  K  A  S  A  D gtcgatggccagaacacagccggcttctcgacagatggcagcaatgtcatcggcttttcg
 V  D  G  Q  N  T  A  G  F  S  T  D  G  S  N  V  I  G  F  S agcttgcacgactctggaaccggcggcaatccatccctaggcaacttttcccctgatgccg
 S  L  H  D  S  G  T  G  G  N  P  S  L  G  N  F  P  L  M  P cagttgtgcgcggaaaatgacattaacaactgctccttctccaagcaagcgcgcgccacg
 Q  L  C  A  E  N  D  I  N  N  C  S  F  S  K  Q  A  R  A  T ccttaccgcaacgattccatcgtggccaggcccgggtattttgcgttgactctggacaac
 P  Y  R  N  D  S  I  V  A  R  P  G  Y  F  A  L  T  L  D  N ggcataagcgcagaaatgaccgtatcccagcacgctgcgttgcataatttcaaattccca
 G  I  S  A  E  M  T  V  S  Q  H  A  A  L  H  N  F  K  F  P gacgtcaacgccagcgacggcacgcaactggtccccatggtcctgctggatctcacggat
 D  V  N  A  S  D  G  T  Q  L  V  P  M  V  L  L  D  L  T  D ctgtgggacagtcgccagaatggaaccttccaggcgcaagggaccaggatgaccggaaac
 L  W  D  S  R  Q  N  G  T  F  Q  A  Q  G  T  R  M  T  G  N gggacgtttctgccgagctttggagcgggatcctacgaagtgcacttctgtgtggatttc
 G  T  F  L  P  S  F  G  A  G  S  Y  E  V  H  F  C  V  D  F ttcggccacaccggccccgtctacgacagtggcatctgggtcaacgaaaggggcggttcg
 F  G  H  T  G  P  V  Y  D  S  G  I  W  V  N  E  R  G  G  S gatcaaaaggagatattcgtcaccaggggtttcaacaacttctatctccaagctggcgga
 D  Q  K  E  I  F  V  T  R  G  F  N  N  F  Y  L  Q  A  G  G tttgtgcggctcctcgcagaagccaacagaaccatcaccgcgagggtgggcttgagctat
 F  V  R  L  L  A  E  A  N  R  T  I  T  A  R  V  G  L  S  Y atcagcgcccagaaggcgtgccggaacgcagaggcggagattccaagcccgctgtcggat
 I  S  A  Q  K  A  C  R  N  A  E  A  E  I  P  S  P  L  S  D ttcaatcgtcttagagcagctgccgaggatgcttggagggacaaactgagcccgataacc
 F  N  R  L  R  A  A  A  E  D  A  W  R  D  K  L  S  P  I  T ctagacgccggtgaggtcagccaggacttgcagaagaacttctggagctcgatttacagg
 L  D  A  G  E  V  S  Q  D  L  Q  K  N  F  W  S  S  I  Y  R acaatgatctcacccccaggactatacgggcgagaatccacgctggaacacgtcagtttat
 T  M  I  S  P  Q  D  Y  T  G  E  N  P  R  W  N  T  S  V  Y ttcgactcgttctattgcctgtgggaccagttcaggtctcagctgccctgctcaccatt
 F  D  S  F  Y  C  L  W  D  Q  F  R  S  Q  L  P  L  L  T  I ctggatccgacggcttattcagacatgctgaacagtctcctgttcatctaccagaatgag
 L  D  P  T  A  Y  S  D  M  L  N  S  L  L  F  I  Y  Q  N  E ggttggctgccggattgccggatgagtttaagcaagggctggactcagggaggctcgaat
 G  W  L  P  D  C  R  M  S  L  S  K  G  W  T  Q  G  G  S  N
```

```
gcagatgtggtactggtggatgcttatttcaagaacgtcaccggtgtggactgggacctt
 A  D  V  V  L  V  D  A  Y  F  K  N  V  T  G  V  D  W  D  L gcctggaaggccgttgtgaatgatgcagaaaatgagccgctggaatggtcaaaggaaggt
 A  W  K  A  V  V  N  D  A  E  N  E  P  L  E  W  S  K  E  G agaggaggcctgctgtcctggaagaacctccactatattccggcccttgattttgactat
 R  G  G  L  L  S  W  K  N  L  H  Y  I  P  A  L  D  F  D  Y cttggtttcgggactaactcgagaagcatctcacgcaccttggaatacgcttacaacgat
 L  G  F  G  T  N  S  R  S  I  S  R  T  L  E  Y  A  Y  N  D tattgcatcggagcgcttggaagagcactggccaaggatggatatgagacgtatttggcc
 Y  C  I  G  A  L  G  R  A  L  A  K  D  G  Y  E  T  Y  L  A cggggcaacaactggaagaacctcttcaaagaggatcaaacttcgattatcaacggcaca
 R  G  N  N  W  K  N  L  F  K  E  D  Q  T  S  I  I  N  G  T gattcaggcttcgtcggcttcttccaacccaagtacctgaacgcaacttggggtttccag
 D  S  G  F  V  G  F  F  Q  P  K  Y  L  N  A  T  W  G  F  Q gatccgatctcgtgcagccctgtggcggggttctgttccctgacaagcaaccttcggag
 D  P  I  S  C  S  P  V  A  G  F  C  S  L  T  S  N  P  S  E acgtttgaatcaagtatctgggagtatcagttttttcgtaccccaagacatggaaacgctc
 T  F  E  S  S  I  W  E  Y  Q  F  F  V  P  Q  D  M  E  T  L attgcaagacttggtggagatcaaagatttgtcgaccggctggactatttccacgagtcg
 I  A  R  L  G  G  D  Q  R  F  V  D  R  L  D  Y  F  H  E  S cccctcgtagatataggaaatgagccggtgttcttgagcgtcttcgaataccattacgca
 P  L  V  D  I  G  N  E  P  V  F  L  S  V  F  E  Y  H  Y  A gggaggcctgcccctttcagcacgacgctctcattcttacatcccgtctcgcttcaacact
 G  R  P  A  L  S  A  R  R  S  H  S  Y  I  P  S  R  F  N  T tcctacagtggcctaccaggaaatgatgatagtggcgcaatgggttcttatgcagctttc
 S  Y  S  G  L  P  G  N  D  D  S  G  A  M  G  S  Y  A  A  F aacatgatgggcctctttcccaaccctggccagaacgtctactttattattccgccgtat
 N  M  M  G  L  F  P  N  P  G  Q  N  V  Y  F  I  I  P  P  Y ttcccgagaatgcaagtgcggcatccagtaacgaatcggacggcgacgatacgtgcggat
 F  P  R  M  Q  V  R  H  P  V  T  N  R  T  A  T  I  R  A  D aatttcgacgccgcttacagcaacatctacatccagaatgcgacgctgaatggagagccg
 N  F  D  A  A  Y  S  N  I  Y  I  Q  N  A  T  L  N  G  E  P tacaccaaaaactggattgggcatgagttcttcacgcagggcggcgagctggtcctgacc
 Y  T  K  N  W  I  G  H  E  F  F  T  Q  G  G  E  L  V  L  T ctaggtagcgaggagagccagtggggaacagctgtagaggatcgaccgccttcggagact
 L  G  S  E  E  S  Q  W  G  T  A  V  E  D  R  P  P  S  E  T ggaggaagtcggactgaggagcggtcttggagcggcctttag
 G  G  S  R  T  E  E  R  S  W  S  G  L  -

SEQ ID NO: 207
LENGTH: 793
TYPE: PRT
ORGANISM: M. phaseolina
MNAMFGFLIALACAASPIAAQAGGFDFDILDFVDPLIGSNGGGNVFCGATLPYGLAKASADVDGQNTAGFSTDG

SNVIGFSSLHDSGTGGNPSLGNFPLMPQLCAENDINNCSFSKQARATPYRNDSIVARPGYFALTLDNGISAEM

TVSQHAALHNFKFPDVNASDGTQLVPMVLLDLTDLWDSRQNGTFQAQGTRMTGNGTFLPSFGAGSYEVHFCVD

FFGHTGPVYDSGIWVNERGGSDQKEIFVTRGFNNFYLQAGGFVRLLAEANRTITARVGLSYISAQKACRNAEA

EIPSPLSDFNRLRAAAEDAWRDKLSPITLDAGEVSQDLQKNFWSSIYRTMISPQDYTGENPRWNTSVYFDSFY

CLWDQFRSQLPLLTILDPTAYSDMLNSLLFIYQNEGWLPDCRMSLSKGWTQGGSNADVVLVDAYFKNVTGVDW

DLAWKAVVNDAENEPLEWSKEGRGGLLSWKNLHYIPALDFDYLGFGTNSRSISRTLEYAYNDYCIGALGRALA

KDGYETYLARGNNWKNLFKEDQTSIINGTDSGFVGFFQPKYLNATWGFQDPISCSPVAGFCSLTSNPSETFES

SIWEYQFFVPQDMETLIARLGGDQRFVDRLDYFHESPLVDIGNEPVFLSVFEYHYAGRPALSARRSHSYIPSR
```

FNTSYSGLPGNDDSGAMGSYAAFNMMGLFPNPGQNVYFIIPPYFPRMQVRHPVTNRTATIRADNFDAAYSNIY

IQNATLNGEPYTKNWIGHEFFTQGGELVLTLGSEESQWGTAVEDRPPSETGGSRTEERSWSGL*

SEQ ID NO: 208
LENGTH: 3232 (including 150 bp 5' UTR and 150 bp 3' UTR)
TYPE: DNA
ORGANISM: M. phaseolina

CCTTTCCAGTCCCGCCCCGGCCCTTGCGCCGCGGCTGACATCAACAGCCGAGTGTTCCTGACGATCCGGACCG

CTCAAAATACCCATCATGTCCCGCTTCGCGTACTTCCAACCCCCCTCTGCACTCCAACTGTCCGCCGTGGGT

CAGCATGGCGGGGTCGTTCGCACTCTTCGCACTGGCCCTGGCCGCTTGCGCACAACATGCTCAAGCCCAAACC

GCTTCCGCCTACGACTTCTTTGACTACATAGATCCCCTGATCGGAACAGTCAATGGAGGTGTGTATCATCTCA

AGGGACTCAAAGTCGCCGCTGATTACGCTATTAGGGCACGTATTCCCCGGCGCCACTTTGCCCTTTGGGATGG

CAAAGGCTGTGGCAGACGTTACCGGCGAGAACCAAGGTGGCTACGCCAGCGACGACAGCGAGATAGTCGGATT

TTCCCACATGGTATAGCTCTCGAGCCGCCCGACTCTATACCTCCTGCTCACTCTGTTCTTTCCAGCATGACTC

AGGCACAGGTGGTTCGCCTTCTCTGGGAAACTTTCCACTTTTCCGTGAGTCAAACACCCTTCAGTCGCTGTTG

TACGGTGCTGATCACAAGAGCAGCTCAGGCAGGTTGCCCAGGAGATGATTTGAACAGATGCGAATTTCCTGCC

GCTGACCGCGCTGTCAAGCGTATATCTCCCCCATGCTGCCTCTTTCTATTCCCTCTTCTGAACAGTCCACAGG

TATTAATGGCACCGCATTCGCTTCCCCGGGCTACTTTACAGTGACGCTCAATACAAGCATCAAGGCCGAGACC

ACCGTGACTAACCACACTGCACTCTGGCGATTCACCTTCCCGGATGTCCCTGTTTCGCCAAATGGCGGAAACT

CCACTGCACCGCTGAGCCCGCTTATCTTGGTAGACCTCAGAGACCTCCCCAGCTCAAGGTCCTACGGCCAAAT

CGCCGTGGACCCTGACACTGGCAGAATTACCGGAAATGGCACATTCGAGCCGTCTTTCGGAATCGGCACTTAT

AATCTATCTTTCTGCGCCGATTTCTCCGGCGCCAATGTACGCGACACAGGCGTTTTCAAGAATAACCGAGCCG

GCTCAGAACCGAAGAATCTGCAGGTAGTGCCGGATAACGTCAATACGGGAAGCGACATCCTCCCAGCGGGTGC

GTGGGTTCGGTTCGAAGCTCCTGCCAGTAACAATCAGATCACCGCACGCGTCGGCATGAGTTTCATTGGCGTT

GAAAAGGCCTGCCAGAATGCTGAGAGCGAGATTCCCGGCTATGACTTTGAAGCTGTGCACACCGCTGCCGAGG

ATGCCTGGAGGCACAAACTCAGTGTCGTTTCCATTGACCCCGCCGGTGTCAACGAAAGCCTGCAAACGACGTT

TTGGTCCGGGTGAGTCAAAGGACGGATGTGTCAAAAAATGCGGTCTCCTTACTAACCTATGCACAGGCTGTAC

CGTACCATGATCTCCCCGCAGGACTACACGGGGGAGAATTACCTATGGGAATCTGATGAGCCCTACTACGACT

CCTTCTACTGCATCTGGGATTCGTATCGGAGTATTCACCCCTTGCTTACCCTCCTGGATCCCGAATCTCAAAC

AAGAATGGTTCGGAGTTTGATTGACATCTATCGCAATGAGTAAGTAATTCCATGGCAGCGCAATGTAGCCGGT

GTTCTAACGCACCATCAAAGGGGATGGCTACCGGATTGCCGCATGAGTCTCTGCAAGGGCTTCACGCAGGGAG

GCTCAAACGCAGATGTAGTACTCGTGGACTCTTTCCTCAAGAACATCACTCAGGATGTGGACTGGGATACAGG

CTACGAAGCGCTGCTCAAAGGTTTGTTATATCGCTTTCCCATTGCCCCAGCTCGGATGGCTGACAGGCTGCAG

ACGCCGAAGAGGAGCCGCTAAATTGGGCTGGTAGGATCTCAGAATCTTCTGTGCAGTCTGTGTGCTAATTGCC

CATAGTTGAGGGCCGAGGCGGCCTAAACAGCTGGAAGAATCTGGGTTATATCCCAACTGTAAGACCACTTCCA

AGAAGCGCCTGTATGGTGTGCTGACTGTTCAGGATGACTATGACCCGTACGGAGTGGGTCCTTTCACTCGATC

TATCTCAAGAACCGTGGAATACGCATACAACGATTATGTGATAGCGCTCATGGCACAAAAGCTCGGGAAAACT

GGTGACTACGAAAAGTACCTGGAGCGCAGCAATAACTGGAGGAACATGTTCAAGGAAGATGAGGTGAGAGGGT

TCTTATAACTTCAAGACATCTTATGCTAAACTCCCACAGGTTTCCTTCTTTAACACAACGCCAGGCGGTCCCA

AGGAAGACAGCGGCTTCACAGGCTTCCTCCAAGTCAAGTACCTCAACGGCACCTGGGGCTACCAAGACCCGAT

CCTCTGCTCCAGCCTCTACAACTTCACCAGCTGTTACCTCAATCCAGATGGCACGAGACCTACGAAGGCTCC

AGCTGGCTCTATACCTTCTACGTCCCGCAGGACATGGCTACCCTGGTCACCGCGCTCGGCGGCCCCGAAACTT

TCACCCGCCGGGTGCAGTACCTGCACTACACCTACAATCTCCTCTACATCGGCGATGAGCAGGCCTTCCTGAC

CGTCTACCTCGCCCACTACTCCGGCCGCCCCGCCGTCTCTGCCGAGATCGCGCACTTCTATATCCCCGCGCAA

-continued

```
TTCAACGACACCGTCATCGGCATCCCCGGCAACGACGACAGCGGCGCCATGGGCAGCTTCTCCAGTTTGACCA

TGATGGGGATATGGCCGGTCGCGGGACAGGACGTCTATCTGATCATCCCGCCCTTCTTCCGCGAGGTCAAAAT

CACGAATCCGGTGACGAGGAAGACGGCGACGATCAGGAACATCAATTTTGATTCGTCTTACCAGGCGATCTAC

GTGCAGAGCGCAACGTTGGATGGAGAGGCGTATACGAAGAGCTGGGTTACGCATAGCTTCTTCTTGGAAGGTG

GTGTGCTGGAGCTCACGCTGGGGAGGAATGAGAGTGATTGGGGGAGGgCAGATGCCGATCGGCCACCGAGTGC

GTCGACCTCTGGTTAAATTCGGGACGCAAAGGCCAAGGCACCTAGTCTGGCGCTGCTAGATTACATTAATTAT

AATGCCTGCAATGATTGACTGGCTGCCAGAACGAGTTTCCTCTGCACCTTTTGATCACTGCTTTGCACTCTTA

AATTTCCATCACAATATGCA

SEQ ID NO: 209
LENGTH: 2415
TYPE: DNA
ORGANISM: M. phaseolina
FEATURE NAME/KEY: CDS
LOCATION: (1)...(2415)
atggcgggtcgttcgcactcttcgcactggccctggccgcttgcgcacaacatgctcaa
 M   A   G   S   F   A   L   F   A   L   A   L   A   A   C   A   Q   H   A   Q gcccaaaccgcttccgcctacgacttctttgactacatagatcccctgatcggaacagtc
 A   Q   T   A   S   A   Y   D   F   F   D   Y   I   D   P   L   I   G   T   V aatggagggcacgtattccccggcgccactttgccctttgggatggcaaaggctgtggca
 N   G   G   H   V   F   P   G   A   T   L   P   F   G   M   A   K   A   V   A gacgttaccggcgagaaccaaggtggctacgccagcgacgacagcgagatagtcggattt
 D   V   T   G   E   N   Q   G   G   Y   A   S   D   D   S   E   I   V   G   F tcccacatgcatgactcaggcacaggtggttcgccttctctgggaaactttccacttttc
 S   H   M   H   D   S   G   T   G   G   S   P   S   L   G   N   F   P   L   F cctcaggcaggttgcccaggagatgatttgaacagatgcgaatttcctgccgctgaccgc
 P   Q   A   G   C   P   G   D   D   L   N   R   C   E   F   P   A   A   D   R gctgtcaagcgtattaatggcaccgcattcgcttccccgggctactttacagtgacgctc
 A   V   K   R   I   N   G   T   A   F   A   S   P   G   Y   F   T   V   T   L aatacaagcatcaaggccgagaccaccgtgactaaccacactgcactctggcgattcacc
 N   T   S   I   K   A   E   T   T   V   T   N   H   T   A   L   W   R   F   T ttcccggatgtccctgtttcgccaaatggcggaaactccactgcaccgctgagcccgctt
 F   P   D   V   P   V   S   P   N   G   G   N   S   T   A   P   L   S   P   L atcttggtagacctcagagacctccccagctcaaggtcctacggccaaatcgccgtggac
 I   L   V   D   L   R   D   L   P   S   S   R   S   Y   G   Q   I   A   V   D cctgacactggcagaattaccggaaatggcacattcgagccgtctttcggaatcggcact
 P   D   T   G   R   I   T   G   N   G   T   F   E   P   S   F   G   I   G   T tataatctatctttctgcgccgatttctccggcgccaatgtacgcgacacaggcgttttc
 Y   N   L   S   F   C   A   D   F   S   G   A   N   V   R   D   T   G   V   F aagaataaccgagccggctcagaaccgaagaatctgcaggtagtgccggataacgtcaat
 K   N   N   R   A   G   S   E   P   K   N   L   Q   V   V   P   D   N   V   N acgggaagcgacatcctcccagcgggtgcgtgggttcggttcgaagctcctgccagtaac
 T   G   S   D   I   L   P   A   G   A   W   V   R   F   E   A   P   A   S   N aatcagatcaccgcacgcgtcggcatgagtttcattggcgttgaaaaggcctgccagaat
 N   Q   I   T   A   R   V   G   M   S   F   I   G   V   E   K   A   C   Q   N gctgagagcgagattcccggctatgactttgaagctgtgcacaccgctgccgaggatgcc
 A   E   S   E   I   P   G   Y   D   F   E   A   V   H   T   A   A   E   D   A tggaggcacaaactcagtgtcgtttccattgaccccgccggtgtcaacgaaagcctgcaa
 W   R   H   K   L   S   V   V   S   I   D   P   A   G   V   N   E   S   L   Q acgacgttttggtccgggctgtaccgtaccatgatctccccgcaggactacacggggag
 T   T   F   W   S   G   L   Y   R   T   M   I   S   P   Q   D   Y   T   G   E aattacctatgggaatctgatgagccctactacgactccttctactgcatctgggattcg
 N   Y   L   W   E   S   D   E   P   Y   Y   D   S   F   Y   C   I   W   D   S tatcggagtattcaccccttgcttaccctcctggatccgaatctcaaacaagaatggtt
 Y   R   S   I   H   P   L   L   T   L   L   D   P   E   S   Q   T   R   M   V
```

-continued

```
cggagtttgattgacatctatcgcaatgagggatggctaccggattgccgcatgagtctc
 R   S   L   I   D   I   Y   R   N   E   G   W   L   P   D   C   R   M   S   L tgcaagggcttcacgcaggaggctcaaacgcagatgtagtactcgtggactcttcctc
 C   K   G   F   T   Q   G   G   S   N   A   D   V   V   L   V   D   S   F   L aagaacatcactcaggatgtggactgggatacaggctacgaagcgctgctcaaagacgcc
 K   N   I   T   Q   D   V   D   W   D   T   G   Y   E   A   L   L   K   D   A gaagaggagccgctaaattgggctgttgagggccgaggcggcctaaacagctggaagaat
 E   E   E   P   L   N   W   A   V   E   G   R   G   G   L   N   S   W   K   N ctgggttatatcccaactgatgactatgacccgtacggagtgggtccttcactcgatct
 L   G   Y   I   P   T   D   D   Y   D   P   Y   G   V   G   P   F   T   R   S atctcaagaaccgtggaatacgcatacaacgattatgtgatagcgctcatggcacaaaag
 I   S   R   T   V   E   Y   A   Y   N   D   Y   V   I   A   L   M   A   Q   K ctcgggaaaactggtgactacgaaaagtacctggagcgcagcaataactggaggaacatg
 L   G   K   T   G   D   Y   E   K   Y   L   E   R   S   N   N   W   R   N   M ttcaaggaagatgaggtttccttctttaacacaacgccaggcggtcccaaggaagacagc
 F   K   E   D   E   V   S   F   F   N   T   T   P   G   G   P   K   E   D   S ggcttcacaggcttcctccaagtcaagtacctcaacggcacctggggctaccaagacccg
 G   F   T   G   F   L   Q   V   K   Y   L   N   G   T   W   G   Y   Q   D   P atcctctgctccagcctctacaacttcaccagctgttacctcaatccagatggccacgag
 I   L   C   S   S   L   Y   N   F   T   S   C   Y   L   N   P   D   G   H   E acctacgaaggctccagctggctctataccttctacgtcccgcaggacatggctaccctg
 T   Y   E   G   S   S   W   L   Y   T   F   Y   V   P   Q   D   M   A   T   L gtcaccgcgctcggcggccccgaaactttcacccgccgggtgcagtacctgcactacacc
 V   T   A   L   G   G   P   E   T   F   T   R   R   V   Q   Y   L   H   Y   T tacaatctcctctacatcggcgatgagcaggccttcctgaccgtctacctcgcccactac
 Y   N   L   L   Y   I   G   D   E   Q   A   F   L   T   V   Y   L   A   H   Y tccggccgccccgccgtctctgccgagatcgcgcacttctatatccccgcgcaattcaac
 S   G   R   P   A   V   S   A   E   I   A   H   F   Y   I   P   A   Q   F   N gacaccgtcatcggcatccccggcaacgacgacagcggcgccatgggcagcttctccagt
 D   T   V   I   G   I   P   G   N   D   D   S   G   A   M   G   S   F   S   S ttgaccatgatggggatatggccggtcgcgggacaggacgtctatctgatcatcccgccc
 L   T   M   M   G   I   W   P   V   A   G   Q   D   V   Y   L   I   I   P   P ttcttccgcgaggtcaaaatcacgaatccggtgacgaggaagacggcgacgatcaggaac
 F   F   R   E   V   K   I   T   N   P   V   T   R   K   T   A   T   I   R   N atcaattttgattcgtcttaccaggcgatctacgtgcagagcgcaacgttggatggagag
 I   N   F   D   S   S   Y   Q   A   I   Y   V   Q   S   A   T   L   D   G   E gcgtatacgaagagctgggttacgcatagcttcttcttggaaggtggtgtgctggagctc
 A   Y   T   K   S   W   V   T   H   S   F   F   L   E   G   G   V   L   E   L acgctggggaggaatgagagtgattggggagggcagatgccgatcggccaccgagtgcg
 T   L   G   R   N   E   S   D   W   G   R   A   D   A   D   R   P   P   S   A tcgacctctggttaa
 S   T   S   G   -
```

SEQ ID NO: 210
LENGTH: 804
TYPE: PRT
ORGANISM: M. phaseolina

MAGSFALFALALAACAQHAQAQTASAYDFFDYIDPLIGTVNGGHVFPGATLPFGMAKAVADVTGENQGGYASD

DSEIVGFSHMHDSGTGGSPSLGNFPLFPQAGCPGDDLNRCEFPAADRAVKRINGTAFASPGYFTVTLNTSIKA

ETTVTNHTALWRFTFPDVPVSPNGGNSTAPLSPLILVDLRDLPSSRSYGQIAVDPDTGRITGNGTFEPSFGIG

TYNLSFCADFSGANVRDTGVFKNNRAGSEPKNLQVVPDNVNTGSDILPAGAWVRFEAPASNNQITARVGMSFI

GVEKACQNAESEIPGYDFEAVHTAAEDAWRHKLSVVSIDPAGVNESLQTTFWSGLYRTMISPQDYTGENYLWE

SDEPYYDSFYCIWDSYRSIHPLLTLLDPESQTRMVRSLIDIYRNEGWLPDCRMSLCKGFTQGGSNADVVLVDS

FLKNITQDVDWDTGYEALLKDAEEEPLNWAVEGRGGLNSWKNLGYIPTDDYDPYGVGPFTRSISRTVEYAYND

-continued

YVIALMAQKLGKTGDYEKYLERSNNWRNMFKEDEVSFFNTTPGGPKEDSGFTGFLQVKYLNGTWGYQDPILCS

SLYNFTSCYLNPDGHETYEGSSWLYTFYVPQDMATLVTALGGPETFTRRVQYLHYTYNLLYIGDEQAFLTVYL

AHYSGRPAVSAEIAHFYIPAQFNDTVIGIPGNDDSGAMGSFSSLTMMGIWPVAGQDVYLIIPPFFREVKITNP

VTRKTATIRNINFDSSYQAIYVQSATLDGEAYTKSWVTHSFFLEGGVLELTLGRNESDWGRADADRPPSASTS

G*

SEQ ID NO: 211
LENGTH: 4669 (including 150 bp 5' UTR and 150 bp 3' UTR)
TYPE: DNA
ORGANISM: M. phaseolina

GACACTACGAGAGTGATTGTGCACTGAGATCGAATGCGCAACTATGAAGGAAGTTACGTCTTTGTACATATGC

AACCGCCTCATATGCGGTCCGGAGTACAAAAACCGTCATTCGTAACGTGCGACGGTCGATGCAGTGCAACGTC

AGCCATGTTCCGGAAGGCTCAAAGCTACACGTGGAGTCCACCAGATTCGGGTGAAACATCTGTGAAGATCAAG

TGCACAGTGCAGTGCGTCGACGTGCACCTGCACAGAGGCACGCAAGTAGCGAAGCTGGCCCCCCCGCCCCGAC

AATCGACCGCCTGAGGGCGACCCGACGGAAGTCGGCCTTGCCACTGTCGCCGAGGCCTGGGGCTGAGGTGAAC

ACTGCCATTATTGCCAATCGCACGGCGCACTCTTCCAAGCCGACTGTCGTTCAGGAAGTGGTGGCAAGCCAAG

TTCCGAGGCGCTGAGGCGGTGCGGCAGGATGGTCACGGCACAGGGCCGAGCAAGGCAGTGATGATATTTCAGG

ACGAGGCGTTGGTCGGCCAAGTCATTTCAGTCCTGGCCTGGGTGGACTAAACCCACCCACCTTCCGAGTCCTC

ATCCCATCACCTCTCCTTGAGAGAGGAGTGCGGAGATTCGCGAGCCAACCACAGCAGCTAAACACGACGACAG

GATTGCAATTCGAGAGCTCCGTGATTCTACAACGTCGGTCGAAACGGGGATCGAGCGTGCAGGAGCGCAAAAG

TCTTGTGACAGCAAAGTGTAGATGGTTCGGCGGGGGTGAAGTTGGTAGAGCGAGCAAAGAGGGTTCGGGAGG

GGCTCTTCAGCGGCAGCAGCGTGGGGAATCCGCTGCCGCCAGCCGAAGCGAAGTTCCAGGAACACCAATGAGA

AGCCGGCGTCTCGGGGCGTGCACCATGCAATGCACGTAGCTCCTCGGGGAAGTCTGCCCCTCACATCACCATT

CCGCCTCCGAACTCCTGCAGGCTCGCCCGTCCAGAAGATCAAACATGCGCCGCCAAAGTGCGTACCTGTTTCC

AGCCTCGAACGCCCACGGGTAGCTCGTATAACTTACTTTCGACCTCATTTCTCCCATCACAGGCAAGGCAGGA

CGCGCGCGGCAGCATGCTATCTTCACTAGCGCAATACAGCCTCTTCCTGCATCTAAACCTGCAGCCAACCCTG

CGGCGCTACCAACGACCCGCGTGCTACCATGTCCTCTATGCCCAGTGGGGCTGTGATGAGCACGCCTGCTCTC

AAAGGCTCCTGATACGCTCACGCGCTAACCACCTGCCCCTCGTGCTGATCCCGCTGCAGCCACCCTATCGCCG

CACCTCCTCGACCAGCGTGTTCAGTCTCCGTCCGTTTTGTGAGAAACTGACACCTGCTCGTGTGCGGCCCCGC

GGATGCTTGCAAGACATTCTGGGTGGGGTTCACCGCCTGCGCTGGTCTTTAAAAAAGAGAGACCAAGCCTTGG

AGAAGCCGTCTCAAGACTCCCAAGAAACCCGCTGCGCATTTCTTGGGCTCGTGCCGCCACTCTTGCGAGCTGG

TCAATCTTCCAACCTGCAGCGCGTCTCTATTCTTGTCATGGCAGGGTGCGGTGCCTAAAGCGGACCCTGACTT

TATAAGACGCGCGACTCTTCGATCCCAGGTGCCTGTTACCACCACTCTCGTGTCTGGCTTTTACATCCTCGTC

CCTCGCTCAACAGACAAAACCCCTTATTCTTTATTTCAATTCCAACCTCCCGCTCTTTTGACTTCGACTTGCA

CCAAGGCCCCACTGATGGGCATGGCATACATCGTTTCGTTCCTGACGCTGGCTGGCGCAGCGCTGGCCCAGTC

CGTAGACTACACTCAATTCGTTGATCCATTGTGAGATTCCCGCATACCTCCAAGCTCTTCTCACTGCCAAGCA

TGACGAGCAAAAACAAAAAAAAAAATATTTCCCTCACCTGCTCCCTCCGCCAACTTTCAACTAACAGGCCCCC

TCCAGCCACGGCACCGAAAATGGCGGTAATACCTTCCCCGGCGTCGTGCCCGGTAAGACCAACAACAACACCA

ACATCACCATCACCACCACCACCAACAACAACAACAAAATCCTCCAACCCAAAACTCCACCCCCCCTCTT

AACGCACACCAGAAACTAACACACCCACGTTAGCACCCTTCTCCGTCACTAAACTCGGCATCGACGTCTCCTC

CGGCACCACGGACGCCTACTCGGGCTACCTGCCGACCGGCAACGTGACGGGCTACAGCATGCTGCACGAGAGC

GGCACGGGCGGCGCGCCCAAGTACGGCGTCGTCGCGCAGCTGCCCGTCGTCGGCGCCGTCGCCAACCCGCTCG

CCGACCTGAGCGTGCCGCGCGCGGTCGACGACGTCGCGGCCGTCGGGTACTACCGCTCGGTGCTGGCGAGCGG

GGTGAGCGTGGAGCTGGCGGGGACGGCGCACGCGGGACTGTACGTTTACGGGTTCCCGGCGGCGCGGGGGAGC

-continued

```
GTGGTGGTGGACGTGTCGCACGTCTTGCCGTCGTTTCGCGGACTGGGGTGGGGGCAGGGCTATGCGGGAGGGG

AGTTCGAGGTGTTTGAGGATGGGCGGTACGAGGGTCACGGGACGTATAATAATGGGTGGAATCTCGGTGAGTG

GGGTGGTGTTTTTTCCCCCCTTTTTTTGGCTGCCGTCTCTTGGATGGAAACTAACGAGGGCGCAGCGCCGAAC

TGGACCATCTACTTTTGCGGCCGCTTCAACGTCACGGCTGCGAGTAGTAAGACCTTCGCCGGGAATGGAACGG

TGCTCTCGCAATATGGAGAGCAGGCGTCCGTTTCTGGGGCGGAGCGTCTAGGCGGCGTGTTCACGTTTAATGA

GACAGCAGTTTCATCGAGGGTCGGCGTGTCGTTCATCTCTTCGGAGAAGGCGTGCGGGTTCTTGGAGGACGAG

CTGCCGTCCGATGCAACGCTGGATTCGCTGGTCCATGATTCGCGGGAAACTTGGAATTCAGAGGTTTTCTCGA

AGGTCACGACGACCGAAACGAACACGACTTATTTGACGCAGCTGTACTCCAGCTTGTACGGGATGCATCTCAT

CCCGTCGAACCGCACGGGAGAGAACCCTCTGTGGGAATCCGATGAGCCATACTACGATGACTGTAAATTGAAC

CATCAGCATCTTGGCCTAACACTGCTAACAAGGGGCTAGGGTTTACGCTTTGGGATCTTTTCCGGTGCACCAC

GCCCTTGATGCATATTCTCCAGCCCGAGGCATACGAAGAGCAAATCAGGTCTTTCATCGACATCTGGAGGCAT

GACGGATTCATGCCTGACGCGAGGTCTTCGAATTGGAATGGCCGCGTCCAGGGAGGAACTAACGCCGATAATG

TTCTTGCGGATGCATATGTGAAAGGTGTCAGAGGAGCCATTGACTGGGAGGACGGATACAGTGAGTTACTCCA

GCCCTCCTTCGACTTGGCATCGTCCAGAGAAAAAGGAAATGGAGGAAAAGGCATATGCTGACAGCTCCTCAGC

CGCCATGGTCACAGATGCGGAGACGGTGCCAGCCAACAGCTATGATCCCTCGACAGCGCCCGACGTGTCATCC

ACTAAAGAGGGGCGGGGAGCGCTGCCGGACTGGCTGAAGTATGGGTGGATCACGCCCACATACTCACGAGCGG

TCTCGCGGGCGGTGGAGTACTCGGCGAATGACTTCGGCCTCTTCCAGGTGGCTGACGGGCTAGGGCGGAGCGA

CGACGCCACCAAATATCTCCGCAGGTCCCGCAACTGGCGCAACCACTGGAACCCCAACGCAACAGTCTCGGGG

ATCAGTGGATTCGTGGTGCCGCGCAATGCCGACGGCAGCTTCGTGCGGCAGGACCCTCTTGCATGTGGATCGT

GCTATTGGGATGCTCCCTACTACGAAGACAACCCGTACACGTACAGCTTCAACGCGATACACGACCTAGCGGA

CGTGATAACCAAGTCGGGCGGGCCAGCCAGGTTTGTCGAGCGATTGGACGCGTTCTTCTCGCAAGGGCTGTAC

AACCCGGGCAACGAGCCGAGCTTCACAACACCTTACCTATACAACTACGCGGGCCGCCAGGAGCTCACGGTCC

GGCAGATCCGCACGACGGGCTACAGCAACTACAATGCGGGCGGGGCGGGATCCCGGGCAACAGCGACGCGGG

GGCGATGCAGAGCTGGATTCTCTGGAACATGGTCGGGCTCTATCCGGTGACGGGGCAGACGACGTTCCTCGTG

GGGAGCCCGTGGTTCGAGCAGGTGACGATCGGGCTGGGCGGCGGCAAGTTCCTCAACATCACGTCCAATCTGG

GGGCGCAGGAGCAGCGCGAGCAGGGCGCGTTCTACGTGCAGAGCTTGAGGGTGAACGGCGAGGCGTGGGATAG

GGCGTGGGTCACATGGGAGGAGGTGTTCGCGAATGGCGGGGAGATGTCGTTCGTGCTTGGCGCGTCGCCGCAG

GCCTGGGCGACGGGGATGCGCCTCCAAGCCCGGCGTCCGGGGCGGGAGACAGCGCGCCAGCCTGATGCCAGC

TCAGGCCGGGGGCGTGAGCAACAGGGACGCGGGCGGTGAAACAGCGGGGTGCGGTACAGGGTACGGTGGCTT

GTCTAGCCTCCAGGCGGCGACGCGGGCGCTGTGGGCGGCTGGGTCGGTGTCGGCGGTGCTGCTTGTAGCG
```

SEQ ID NO: 212
LENGTH: 2289
TYPE: DNA
ORGANISM: M. phaseolina
FEATURE NAME/KEY: CDS
LOCATION: (1)...(2289)

```
atgttccggaaggctcaaagctacacgtggagtccaccagattcgggtgaaacatctgtg
 M   F   R   K   A   Q   S   Y   T   W   S   P   P   D   S   G   E   T   S   V aagatcaagtgcacagtgcaccacggcaccgaaaatggcggtaataccttccccggcgtc
 K   I   K   C   T   V   H   H   G   T   E   N   G   G   N   T   F   P   G   V gtgcccgcacccttctccgtcactaaactcggcatcgacgtctcctccggcaccacggac
 V   P   A   P   F   S   V   T   K   L   G   I   D   V   S   S   G   T   T   D gcctactcgggctacctgccgaccggcaacgtgacgggctacagcatgctgcacgagagc
 A   Y   S   G   Y   L   P   T   G   N   V   T   G   Y   S   M   L   H   E   S ggcacgggcggcgcgcccaagtacggcgtcgtcgcgcagctgcccgtcgtcggcgccgtc
 G   T   G   G   A   P   K   Y   G   V   V   A   Q   L   P   V   V   G   A   V
```

```
gccaacccgctcgccgacctgagcgtgccgcgcgcggtcgacgacgtcgcggccgtcggg
 A  N  P  L  A  D  L  S  V  P  R  A  V  D  D  V  A  A  V  G tactaccgctcggtgctggcgagcggggtgagcgtggagctggcggggacggcgcacgcg
 Y  Y  R  S  V  L  A  S  G  V  S  V  E  L  A  G  T  A  H  A ggactgtacgtttacgggttccccggcggcgcggggagcgtggtggtggacgtgtcgcac
 G  L  Y  V  Y  G  F  P  A  A  R  G  S  V  V  V  D  V  S  H gtcttgccgtcgtttcgcggactgggtgggggcagggctatgcgggaggggagttcgag
 V  L  P  S  F  R  G  L  G  W  G  Q  G  Y  A  G  G  E  F  E gtgtttgaggatgggcggtacgagggtcacgggacgtataataatgggtggaatctcgcg
 V  F  E  D  G  R  Y  E  G  H  G  T  Y  N  N  G  W  N  L  A ccgaactggaccatctactttgcggccgcttcaacgtcacggctgcgagtagtaagacc
 P  N  W  T  I  Y  F  C  G  R  F  N  V  T  A  A  S  S  K  T ttcgccgggaatggaacggtgctctcgcaatatggagagcaggcgtccgtttctggggcg
 F  A  G  N  G  T  V  L  S  Q  Y  G  E  Q  A  S  V  S  G  A gagcgtctaggcggcgtgttcacgtttaatgagacagcagtttcatcgagggtcggcgtg
 E  R  L  G  G  V  F  T  F  N  E  T  A  V  S  S  R  V  G  V tcgttcatctcttcggagaaggcgtgcgggttcttggaggacgagctgccgtccgatgca
 S  F  I  S  S  E  K  A  C  G  F  L  E  D  E  L  P  S  D  A acgctggattcgctggtccatgattcgcgggaaacttggaattcagaggttttctcgaag
 T  L  D  S  L  V  H  D  S  R  E  T  W  N  S  E  V  F  S  K gtcacgacgaccgaaacgaacacgacttatttgacgcagctgtactccagcttgtacggg
 V  T  T  T  E  T  N  T  T  Y  L  T  Q  L  Y  S  S  L  Y  G atgcatctcatcccgtcgaaccgcacgggagagaaccctctgtgggaatccgatgagcca
 M  H  L  I  P  S  N  R  T  G  E  N  P  L  W  E  S  D  E  P tactacgatgactggtttacgctttgggatctttccggtgcaccacgcccttgatgcat
 Y  Y  D  D  W  F  T  L  W  D  L  F  R  C  T  T  P  L  M  H attctccagcccgaggcatacgaagagcaaatcaggtctttcatcgacatctggaggcat
 I  L  Q  P  E  A  Y  E  E  Q  I  R  S  F  I  D  I  W  R  H gacggattcatgcctgacgcgaggtcttcgaattggaatggccgcgtccagggaggaact
 D  G  F  M  P  D  A  R  S  S  N  W  N  G  R  V  Q  G  G  T aacgccgataatgttcttgcggatgcatatgtgaaaggtgtcagaggagccattgactgg
 N  A  D  N  V  L  A  D  A  Y  V  K  G  V  R  G  A  I  D  W gaggacggatacaccgccatggtcacagatgcggagacggtgccagccaacagctatgat
 E  D  G  Y  T  A  M  V  T  D  A  E  T  V  P  A  N  S  Y  D ccctcgacagcgcccgacgtgtcatccactaaagaggggcggggagcgctgccggactgg
 P  S  T  A  P  D  V  S  S  T  K  E  G  R  G  A  L  P  D  W ctgaagtatgggtggatcacgcccacatactcacgagcggtctcgcgggcggtggagtac
 L  K  Y  G  W  I  T  P  T  Y  S  R  A  V  S  R  A  V  E  Y tcggcgaatgacttcggcctcttccaggtggctgacgggctaggcggagcgacgacgcc
 S  A  N  D  F  G  L  F  Q  V  A  D  G  L  G  R  S  D  D  A accaaatatctccgcaggtcccgcaactggcgcaaccactggaaccccaacgcaacagtc
 T  K  Y  L  R  R  S  R  N  W  R  N  H  W  N  P  N  A  T  V tcggggatcagtggattcgtggtgccgcgcaatgccgacggcagcttcgtgcggcaggac
 S  G  I  S  G  F  V  V  P  R  N  A  D  G  S  F  V  R  Q  D cctcttgcatgtggatcgtgctattgggatgctccctactacgaagacaacccgtacacg
 P  L  A  C  G  S  C  Y  W  D  A  P  Y  Y  E  D  N  P  Y  T tacagcttcaacgcgatacacgacctagcggacgtgataaccaagtcgggcgggccagcc
 Y  S  F  N  A  I  H  D  L  A  D  V  I  T  K  S  G  G  P  A aggtttgtcgagcgattggacgcgttcttctcgcaagggctgtacaacccgggcaacgag
 R  F  V  E  R  L  D  A  F  F  S  Q  G  L  Y  N  P  G  N  E ccgagcttcacaacaccttacctatacaactacgcggggcgccaggagctcacggtccgg
 P  S  F  T  T  P  Y  L  Y  N  Y  A  G  R  Q  E  L  T  V  R cagatccgcacgacgggctacagcaactacaatgcggggcggggcgggatcccgggcaac
 Q  I  R  T  T  G  Y  S  N  Y  N  A  G  R  G  G  I  P  G  N
```

-continued

```
agcgacgcgggggcgatgcagagctggattctctggaacatggtcgggctctatccggtg
 S  D  A  G  A  M  Q  S  W  I  L  W  N  M  V  G  L  Y  P  V acggggcagacgacgttcctcgtggggagcccgtggttcgagcaggtgacgatcgggctg
 T  G  Q  T  T  F  L  V  G  S  P  W  F  E  Q  V  T  I  G  L ggcggcggcaagttcctcaacatcacgtccaatctgggggcgcaggagcagcgcgagcag
 G  G  G  K  F  L  N  I  T  S  N  L  G  A  Q  E  Q  R  E  Q ggcgcgttctacgtgcagagcttgagggtgaacggcgaggcgtgggataggggcgtgggtc
 G  A  F  Y  V  Q  S  L  R  V  N  G  E  A  W  D  R  A  W  V acatggaggaggtgttcgcgaatggcggggagatgtcgttcgtgcttggcgcgtcgccg
 T  W  E  E  V  F  A  N  G  G  E  M  S  F  V  L  G  A  S  P caggcctgggcgacgggggatgcgcctccaagcccggcgtccggggcgggagacagcgcg
 Q  A  W  A  T  G  D  A  P  P  S  P  A  S  G  A  G  D  S  A ccagcctga
 P  A  -
```

SEQ ID NO: 213
LENGTH: 762
TYPE: PRT
ORGANISM: M. phaseolina

MFRKAQSYTWSPPDSGETSVKIKCTVHHGTENGGNTFPGVVPAPFSVTKLGIDVSSGTTDAYSGYLPTGNVTG

YSMLHESGTGGAPKYGVVAQLPVVGAVANPLADLSVPRAVDDVAAVGYYRSVLASGVSVELAGTAHAGLYVYG

FPAARGSVVVDVSHVLPSFRGLGWGQYAGGEFEVFEDGRYEGHGTYNNGWNLAPNWTIYFCGRFNVTAASSK

TFAGNGTVLSQYGEQASVSGAERLGGVFTFNETAVSSRVGVSFISSEKACGFLEDELPSDATLDSLVHDSRET

WNSEVFSKVTTTETNTTYLTQLYSSLYGMHLIPSNRTGENPLWESDEPYYDDWFTLWDLFRCTTPLMHILQPE

AYEEQIRSFIDIWRHDGEMPDARSSNWNGRVQGGTNADNVLADAYVKGVRGAIDWEDGYTAMVTDAETVPANS

YDPSTAPDVSSTKEGRGALPDWLKYGWITPTYSRAVSRAVEYSANDFGLFQVADGLGRSDDATKYLRRSRNWR

NHWNPNATVSGISGFVVPRNADGSFVRQDPLACGSCYWDAPYYEDNPYTYSFNAIHDLADVITKSGGPARFVE

RLDAFFSQGLYNPGNEPSFTTPYLYNYAGRQELTVRQIRTTGYSNYNAGRGGIPGNSDAGAMQSWILWNMVGL

YPVTGQTTFLVGSPWFEQVTIGLGGGKFLNITSNLGAQEQREQGAFYVQSLRVNGEAWDRAWVTWEEVFANGG

EMSFVLGASPQAWATGDAPPSPASGAGDSAPA*

SEQ ID NO: 214
LENGTH: 2912 (including 150 bp 5' UTR and 150 bp 3' UTR)
TYPE: DNA
ORGANISM: M. phaseolina

CCTGTCGATGCGGGTGACGGATGATCACGCCTTGTTCCCTGGACTCATGTATATCTCGCCCCGCGCCCCGTGT

CGGCTGCTTGCTGCTGTAGGTTCGTCGCCCTCTGTCGCGTCGTCTCTGAATTCGCTCGTTTCGTCTTCTCTTT

GACCATGGGCCTCAAGCATCTACCCGCTCTCTTGCTGGCTGGCCTCTGTACCTCTCCGGTGCACGCTCAGTTC

GATGCTCTGCAGTATGTCGATCAGCTGATTGGCAGCAGCAACGGCGGTGCGTTTCGAAGTATCTGGGCAGGGA

TCATGCGCTGAAACAACGACCAGGAAATGTCTTCTCTGGCGCAGGCCTTCCTTACGGAATGGTATGTCCATAC

TCACTGCAAACCTGACAGGAACACATACTGTCGTACAAAACGACTGAGTGCTAAGCTGCCTCGCAGGCCAAAG

CCGTGGCGGACACGGATTCCCAGAGTAACCAGGGTGGCTTCACGACTGATGGTGCCAACATCACCGGCTTCAG

CCAGATGCACGATTCCGGAACAGGAGGGAGCCCTTCTCTTGGACTCTTCGCCCTGTTCCCTTACCCCAGCTGC

CGTGGCGACGATGTCAACAACTGCGTCTTCCCAAGAGAGCTCGGCGGACTCGGTACCGGAACGAGTCGCTGC

AAGCCAGTCCCGGCTACTTCAGCCTGACTCTGAACAGCGGTGTGAATGTCGAGATGACTTCCGCTCAGCACAC

CAATCTTTTCAGGTTCAATTTCCCTTCTGATACGGACGGGAGCCCCCTGATCCTTTTGGATCTGACCGACCTC

TCAGATTCCCGCCAGGATAACGGAACCATCACCGTTGATGGCGACACCGGAAGGATGTCTGGAAATGCTCGGT

TCAATCCCAGTTTCGGACAGGGCAACTACGTAGCGTATTTCTGCGCGGATTTCCAAGGTCCCAACATTCGCGA

TAATGGAATCTTTGTCAATAGCCGGGCCAGTGCTGACGTCAAGAACCTCACCATTTCGCGCTCCATCAACGGA

TATCCTCTTCCCGGCGGCGGTTTCACccGATTTGATGGCCCCGGCGAGAACGGTGTCCTTGCCCGCGTGGGCG

-continued

```
TCAGCCTCATCAGCGAGCAGCAAGCTTGCAGTAACGCCGAGTCCGAGATTCCGGATTTCAACTTCGAGCGCGT

GCAGACTGAGGCAGTCCAACAGTGGAGACAGAAGCTCAGCCCCATCCAGGCATCAACAAACGGCGTCGATCGG

GACTTGCTCGTCAACTTTTACAGTGGTATCTACCGCGCCTTCGTCAACCCTCAGGATTACACTGGAGAGAACC

CGTTGTGGCAGAGTGACGAGCCGTACTTTGACTCGTTCTACTGCATCTGGGATCTTTTCCGCTCTCAGATGCC

GTTTTTGACAATCGTGGATCCCGAAGCAGTCTCCAGGATGGTTCGATCTCTCATTGACACATACAGGAATGTT

GGTTGGCTTCCAGACTGCCGCATGACCCTGAACAAGGGCTACACGCAAGGCGGATCCAACGCCGACGTAATTC

TTGCCGATGTGTACTTGAAGGGCGTGAGAGATGGAATTAATTGGGAGGACGGCTACGCCGCTGTCGTGAAGGA

TGCAGAAGTCGAACCCTACGACTGGTGCTGCCAAGGCCGCGGGGGGCTCGATAGCTGGAAGTCACTGGGCTAT

ATTCCGGTGGAGGACTTCGACTACAAGGGGTTTGGTACCATGACCCGGAGTGTCTCTCGCACTCTTGAATACT

CGTACAACGACTTCACTATCTCGGAACTCGCCGGTAGGATTGGCAACCTGGAAGCCGATGTGGAGAAGTACCA

GGAACGCAGCGGCAACTGGCAGAACCTCTTTAAGGTTAATCAGACTTCCTTCCTGAACGGCACTGATACTGGC

TTCGTCGGATTCTTCCAACCGCGCTACCTCAACGGCACCTGGGGCTTCCAGGACCCGCTGCGGTGCAGCAACA

TCGACCCCTTTCCCAACAGCGTCTGCAGCCTGCAGAACACTGCTGGCGAGACGTTCGAATCCTCCATCTGGGA

ATACAGCTACTACGTCCCTCACGACCAAGCTGCACTCATCACTGCCTTTGGCGGGCCCGCTGAGTTCGTGCGC

CGGCTCGAGTATCTGCATGACCGCAACATCACGTACATCGGTAACGAGCCCTCTTTCCTCACCGTCTTCCAGT

ACCATTACGCAGGACGGCCTGCACTTTCGGCCCGCCGCAGCCACTACTACATCCCGGGCTTCTTCGGCACCAC

GTTCGACGGCCTGCCCGGCAACGACGATAGCGGGACCATGGGGGCCTTCGTCGCCTTCTCCATGATGGGTCTC

TTCCCCAACCCGGGCCAGGACGTGTACTTCATCATCCCCCCTTACTTCGAGTCGGTCAACATCACCCACCCGC

TGACCAACCGCACCGCCACCATCCGCAACGTCAACTTCGATCCCAGTTACGAGGCGATTTATATCCAGAGCGC

GACGCTCGACGGCGAGCCGTACACGAAGAATTGGATCGACCACTCCTTTTTCACAGAGGGCAAGGAGCTTGTG

CTCACGCTCGGCAGGAACGAGAGCGCGTGGGCACCCGCGTCGAGGATCTGCCGCCCAGTTTGAGCGAATATC

AAGGCTTCAACTCGAGCGCGGCGACCGCAGCGGGGAGCAGGAGGCGGCCTTGAAGAGGAGTGCCCCGAAGAT

CGCGCCAAGACACCCCATGGCGATGGATTTCTGGCCCGAGGGAAAGGTTGTGGAGTTTTAGCGAGTGAAGGAG

GTTTATGTGGCTGGGACTTGCGTTTTCGCTTCTTATGACGGGCTGCCGACTGCGTGCGGCAGGCGCTTTGATG

GCAGTGAGCGGGTGTCTTGCTGACCGGATTATAGATAATGCAAAGGAAAATATATTTCTCCTGAC
```

```
SEQ ID NO: 215
LENGTH: 2484
TYPE: DNA
ORGANISM: M. phaseolina
FEATURE NAME/KEY: CDS
LOCATION: (1)...(2484)
atgggcctcaagcatctacccgctctcttgctggctggcctctgtacctctccggtgcac
 M   G   L   K   H   L   P   A   L   L   L   A   G   L   C   T   S   P   V   H gctcagttcgatgctctgcagtatgtcgatcagctgattggcagcagcaacggcggaaat
 A   Q   F   D   A   L   Q   Y   V   D   Q   L   I   G   S   S   N   G   G   N gtcttctctggcgcaggccttccttacggaatggccaaagccgtggcggacacggattcc
 V   F   S   G   A   G   L   P   Y   G   M   A   K   A   V   A   D   T   D   S cagagtaaccagggtggcttcacgactgatggtgccaacatcaccggcttcagccagatg
 Q   S   N   Q   G   G   F   T   T   D   G   A   N   I   T   G   F   S   Q   M cacgattccggaacaggagggagcccttctcttggactcttcgccctgttcccttacccc
 H   D   S   G   T   G   G   S   P   S   L   G   L   F   A   L   F   P   Y   P agctgccgtggcgacgatgtcaacaactgcgtcttccccaagagagctcggcggactcgg
 S   C   R   G   D   D   V   N   N   C   V   F   P   K   R   A   R   R   T   R taccggaacgagtcgctgcaagccagtcccggctacttcagcctgactctgaacagcggt
 Y   R   N   E   S   L   Q   A   S   P   G   Y   F   S   L   T   L   N   S   G gtgaatgtcgagatgacttccgctcagcacaccaatctttttcaggttcaatttcccttct
 V   N   V   E   M   T   S   A   Q   H   T   N   L   F   R   F   N   F   P   S
```

-continued

```
gatacggacgggagcccctgatccttttggatctgaccgacctctcagattcccgccag
 D   T   D   G   S   P   L   I   L   L   D   L   T   D   L   S   D   S   R   Q gataacggaaccatcaccgttgatggcgacaccggaaggatgtctggaaatgctcggttc
 D   N   G   T   I   T   V   D   G   D   T   G   R   M   S   G   N   A   R   F aatcccagtttcggacagggcaactacgtagcgtatttctgcgcggatttccaaggtccc
 N   P   S   F   G   Q   G   N   Y   V   A   Y   F   C   A   D   F   Q   G   P aacattcgcgataatggaatctttgtcaatagccgggccagtgctgacgtcaagaacctc
 N   I   R   D   N   G   I   F   V   N   S   R   A   S   A   D   V   K   N   L accatttcgcgctccatcaacggatatcctcttcccggcggcggtttcacccgatttgat
 T   I   S   R   S   I   N   G   Y   P   L   P   G   G   G   F   T   R   F   D ggcccggcgagaacggtgtccttgcccgcgtgggcgtcagcctcatcagcgagcagcaa
 G   P   G   E   N   G   V   L   A   R   V   G   V   S   L   I   S   E   Q   Q gcttgcagtaacgccgagtccgagattccggatttcaacttcgagcgcgtgcagactgag
 A   C   S   N   A   E   S   E   I   P   D   F   N   F   E   R   V   Q   T   E gcagtccaacagtggagacagaagctcagccccatccaggcatcaacaaacggcgtcgat
 A   V   Q   Q   W   R   Q   K   L   S   P   I   Q   A   S   T   N   G   V   D cgggacttgctcgtcaacttttacagtggtatctaccgcgccttcgtcaaccctcaggat
 R   D   L   L   V   N   F   Y   S   G   I   Y   R   A   F   V   N   P   Q   D tacactggagagaacccgttgtggcagagtgacgagccgtactttgactcgttctactgc
 Y   T   G   E   N   P   L   W   Q   S   D   E   P   Y   F   D   S   F   Y   C atctgggatctttccgctctcagatgccgttttgacaatcgtggatcccgaagcagtc
 I   W   D   L   F   R   S   Q   M   P   F   L   T   I   V   D   P   E   A   V tccaggatggttcgatctctcattgacacatacaggaatgttggttggcttccagactgc
 S   R   M   V   R   S   L   I   D   T   Y   R   N   V   G   W   L   P   D   C cgcatgaccctgaacaagggctacacgcaaggcggatccaacgccgacgtaattcttgcc
 R   M   T   L   N   K   G   Y   T   Q   G   G   S   N   A   D   V   I   L   A gatgtgtacttgaagggcgtgagagatggaattaattgggaggacggctacgccgctgtc
 D   V   Y   L   K   G   V   R   D   G   I   N   W   E   D   G   Y   A   A   V gtgaaggatgcagaagtcgaaccctacgactggtgctgccaaggccgcggggggctcgat
 V   K   D   A   E   V   E   P   Y   D   W   C   C   Q   G   R   G   G   L   D agctggaagtcactgggctatattccggtggaggacttcgactacaaggggtttggtacc
 S   W   K   S   L   G   Y   I   P   V   E   D   F   D   Y   K   G   F   G   T atgacccggagtgtctctcgcactcttgaatactcgtacaacgacttcactatctcggaa
 M   T   R   S   V   S   R   T   L   E   Y   S   Y   N   D   F   T   I   S   E ctcgccggtaggattggcaacctggaagccgatgtggagaagtaccaggaacgcagcggc
 L   A   G   R   I   G   N   L   E   A   D   V   E   K   Y   Q   E   R   S   G aactggcagaacctctttaaggttaatcagacttccttcctgaacggcactgatactggc
 N   W   Q   N   L   F   K   V   N   Q   T   S   F   L   N   G   T   D   T   G ttcgtcggattcttccaaccgcgctacctcaacggcacctggggcttccaggacccgctg
 F   V   G   F   F   Q   P   R   Y   L   N   G   T   W   G   F   Q   D   P   L cggtgcagcaacatcgaccccttttcccaacagcgtctgcagcctgcagaacactgctggc
 R   C   S   N   I   D   P   F   P   N   S   V   C   S   L   Q   N   T   A   G gagacgttcgaatcctccatctgggaatacagctacgtccctcacgaccaagctgca
 E   T   F   E   S   S   I   W   E   Y   S   Y   Y   V   P   H   D   Q   A   A ctcatcactgcctttggcgggcccgctgagttcgtgcgccggctcgagtatctgcatgac
 L   I   T   A   F   G   G   P   A   E   F   V   R   R   L   E   Y   L   H   D cgcaacatcacgtacatcggtaacgagccctcttttcctcaccgtcttccagtaccattac
 R   N   I   T   Y   I   G   N   E   P   S   F   L   T   V   F   Q   Y   H   Y gcaggacggcctgcactttcggcccgccgcagccactactacatcccgggcttcttcggc
 A   G   R   P   A   L   S   A   R   R   S   H   Y   Y   I   P   G   F   F   G accacgttcgacggcctgcccggcaacgacgatagcgggaccatgggggccttcgtcgcc
 T   T   F   D   G   L   P   G   N   D   D   S   G   T   M   G   A   F   V   A ttctccatgatgggtctcttccccaacccgggccaggacgtgtacttcatcatccccct
 F   S   M   M   G   L   F   P   N   P   G   Q   D   V   Y   F   I   I   P   P
```

```
tacttcgagtcggtcaacatcacccacccgctgaccaaccgcaccgccaccatccgcaac
 Y  F  E  S  V  N  I  T  H  P  L  T  N  R  T  A  T  I  R  N gtcaacttcgatcccagttacgaggcgatttatatccagagcgcgacgctcgacggcgag
 V  N  F  D  P  S  Y  E  A  I  Y  I  Q  S  A  T  L  D  G  E ccgtacacgaagaattggatcgaccactccttttcacagagggcaaggagcttgtgctc
 P  Y  T  K  N  W  I  D  H  S  F  F  T  E  G  K  E  L  V  L acgctcggcaggaacgagagcgcgtggggcacccgcgtcgaggatctgccgcccagtttg
 T  L  G  R  N  E  S  A  W  G  T  R  V  E  D  L  P  P  S  L agcgaatatcaaggcttcaactcgagcgcggcgaccgcagcggggagcaggagggcggcc
 S  E  Y  Q  G  F  N  S  S  A  A  T  A  A  G  S  R  R  A  A ttgaagaggagtgccccgaagatcgcgccaagacacccatggcgatggatttctggccc
 L  K  R  S  A  P  K  I  A  P  R  H  P  M  A  M  D  F  W  P gagggaaaggttgtggagttttag
 E  G  K  V  V  E  F  -

SEQ ID NO: 216
LENGTH: 827
TYPE: PRT
ORGANISM: M. phaseolina
MGLKHLPALLLAGLCTSPVHAQFDALQYVDQLIGSSNGGNVFSGAGLPYGMAKAVADTDSQSNQGGFTTDGAN

ITGFSQMHDSGTGGSPSLGLFALFPYPSCRGDDVNNCVFPKRARRTRYRNESLQASPGYFSLTLNSGVNVEMT

SAQHTNLFRFNFPSDTDGSPLILLDLTDLSDSRQDNGTITVDGDTGRMSGNARFNPSFGQGNYVAYFCADFQG

PNIRDNGIFVNSRASADVKNLTISRSINGYPLPGGGFTRFDGPGENGVLARVGVSLISEQQACSNAESEIPDF

NFERVQTEAVQQWRQKLSPIQASTNGVDRDLLVNFYSGIYRAFVNPQDYTGENPLWQSDEPYFDSFYCIWDLF

RSQMPFLTIVDPEAVSRMVRSLIDTYRNVGWLPDCRMTLNKGYTQGGSNADVILADVYLKGVRDGINWEDGYA

AVVKDAEVEPYDWCCQGRGGLDSWKSLGYIPVEDFDYKGFGTMTRSVSRTLEYSYNDFTISELAGRIGNLEAD

VEKYQERSGNWQNLFKVNQTSFLNGTDTGFVGFFQPRYLNGTWGFQDPLRCSNIDPFPNSVCSLQNTAGETFE

SSIWEYSYYVPHDQAALITAFGGPAEFVRRLEYLHDRNITYIGNEPSFLTVFQYHYAGRPALSARRSHYYIPG

FFGTTFDGLPGNDDSGTMGAFVAFSMMGLFPNPGQDVYFIIPPYFESVNITHPLTNRTATIRNVNFDPSYEAI

YIQSATLDGEPYTKNWIDHSFFTEGKELVLTLGRNESAWGTRVEDLPPSLSEYQGFNSSAATAAGSRRAALKR

SAPKIAPRHPMAMDFWPEGKVVEF*

SEQ ID NO: 217
LENGTH: 2066 (including 150 bp 5' UTR and 150 bp 3' UTR)
TYPE: DNA
ORGANISM: M. phaseolina
GCGGCGACAGGAGCTGTTCTTGATTCATCAGGGCGCAGCCTGTGCCTGCCAAGTTCCCGGGCTGCGGGATCTT

AAAAGCTGCCGGCCCGCCGCTCTGGATAGTCGGTAGTCCACGGCATCACTATCACCGTGCTGCAACCTCCAAA

CACAATGCGCTGGGCCTCGACTCTGCTGCCGTCCGCCACCGGCGCGCTGCTCTTCGCTGCCCTGGCAAATGGC

GCTCCCGCAGTCGGCTCCGCCGCCACGCCCACGCTGAAGGAGAGGCAGACGTCCGACAGATTAGTCTTCGCCC

ATTTCATGGTATGTACATGCACACGCATCTCGCCAAGCCACAAGCTTGTGCTAACCAGCCGCCAGATCGGCAT

CTCGACCGACCGCACCAGCTCCGCCGATTACGACGCCGACATCCTGCGTGCCAAATCTCTAGGCATTGACGCC

TTCGCTCTCAACTTCGGCCCCGACACCGCCAGCGCCAACTACAGCCAGCAACTCGTGTACGCCTATGAGTCGG

CCGCCAACAACGGCTTCAGCGTCTTCCTCTCCTTCGACTTCAACACTGGCCTGTGGGACACCGCTGACGCCGC

GGCTGTCGGCGCCCGCATCGCTGCATTCGGCAGCCGCGGTGGCCAGCTGAAGGTTGACGACAAGGCGTTTGTC

TCTTCTTTTGTTGGCGATGCGCTCGATGTCTCGGCCGTGAGGACGGCAGCCGGCATTGACATCTTCTTTGCCC

CGAACTTCAACCCCGGCGGCGGTGCGGATTGGACTCAGTTGGACGGCGCGTTCAGTTGGTGGGTCGAGGCCCT

GAGAGGCGATTGCCGGTTGTGCTGACGACGGGGCAGGTATGCTTGGCCAACCGACGGTTCCAACAACCCTCCT

TCCTCCACCAGCACCTACCTGCCCACCTATGCCGACACCGACTACACCACCAAGCTGGGCGGCGACAAGACGA

AATACGTAGCCCGTAAGTGCATAGCCCCTTCGCACGCCGCCATCGCAGCCACTGACCCGTGCAGCCGTGTCGC
```

```
CCTGGTTCTTCACGCACTACGGCAGCGAGGTGTCCTTCGGCCCCAAGAACTATGTAAGCCACCCCGCCCGACG

ACGACCCCATCGACCTGCCCACTAACCCTCTCTCGCGCCAGCTCTTCCCCTCCGAGTTCCTCTGGTTCACGCG

CTGGCAAGAGATCCTTGACCTCGGGTCGCGCTTCGTCGAAATCATCACCTGGAACGGTAAGCCACTGCCTCCC

GCCCACCTCCCACCGCCCCGCCATACTCACCCCCTCTCCTTAGACTACGGCGAGTCGCACTACATCGGCCCGC

TCTCCTCCCCGCACTACGACGACGGCAACAGCAAATGGACCAACGACATGCCGCACAACGGCTGGGCCGACCT

CGCCGCCCCTACATCGCCGCCTACAAAGCCGGCGCCACCTCGCCCACCTCCTACATCACCACTGACAGGCTG

GTCTACTGGTTCCGCCCGCAGCCGAAAGGCCTCGACTGCGCCTCGACCGACAACGTCGGCGCCGCGCCCTCTG

GCGCCGACCTCGTCGCCGACAAGCTGTTCGTCGTGACGATGCTGACGGACGCCGCGAACGTGACGGTCGGATC

GGGCGGCGATGCCACGCAGACGTTCGCCGCGCCGAAGGGCGTCGCCAGCTTTACGGTGCCGCTGGCCGTGGGC

GTGCAGGCGTTCGCGGTCGAGCGCGGCGGCGTCGCCGTCGACGGCCTAGGCGGGCAGGCGCCGAAGCAGGTCA

GCGGCGAGTGTGTGTGCGGGCTGTACAACTTCAATGCGTTCGTCGGCACCCTGCCGGTCGCGGAGCAGGGCGA

CGCGTTGCAGGCCGATGGGCTGAGCAGGTTCACCGAGGGCTTGAAGGTCGCGACGTGCAGTCCGACGCCGACG

TTGGCCGCCAGGCGGTGAGGTGCTTGGGGCTTGGTGGGAGGCTGTGACATGGTCCGGGTTCGGCGAGGGGACC

GTCTGGCTAATGGAGGAGGTGTCGCACTCGGGTGTTATCTGCCGAGGATGCGAAGCCTATCAACCGCCTGAAT

TGTATTCTATTGTTGGATGTAT

SEQ ID NO: 218
LENGTH: 1485
TYPE: DNA
ORGANISM: M. phaseolina
FEATURE NAME/KEY: CDS
LOCATION: (1)...(1485)
atgcgctgggcctcgactctgctgccgtccgccaccggcgcgctgctcttcgctgccctg
 M   R   W   A   S   T   L   L   P   S   A   T   G   A   L   L   F   A   A   L gcaaatggcgctcccgcagtcggctccgccgccacgcccacgctgaaggagaggcagacg
 A   N   G   A   P   A   V   G   S   A   A   T   P   T   L   K   E   R   Q   T tccgacagattagtcttcgcccatttcatgatcggcatctcgaccgaccgcaccagctcc
 S   D   R   L   V   F   A   H   F   M   I   G   I   S   T   D   R   T   S   S gccgattacgacgccgacatcctgcgtgccaaatctctaggcattgacgccttcgctctc
 A   D   Y   D   A   D   I   L   R   A   K   S   L   G   I   D   A   F   A   L aacttcggccccgacaccgccagcgccaactacagccagcaactcgtgtacgcctatgag
 N   F   G   P   D   T   A   S   A   N   Y   S   Q   Q   L   V   Y   A   Y   E tcggccgccaacaacggcttcagcgtcttcctctccttcgacttcaacactggcctgtgg
 S   A   A   N   N   G   F   S   V   F   L   S   F   D   F   N   T   G   L   W gacaccgctgacgccgcggctgtcggcgcccgcatcgctgcattcggcagccgcggtggc
 D   T   A   D   A   A   A   V   G   A   R   I   A   A   F   G   S   R   G   G cagctgaaggttgacgacaaggcgtttgtctcttcttttgttggcgatgcgctcgatgtc
 Q   L   K   V   D   D   K   A   F   V   S   S   F   V   G   D   A   L   D   V tcggccgtgaggacggcagccggcattgacatcttctttgccccgaacttcaacccggc
 S   A   V   R   T   A   A   G   I   D   I   F   F   A   P   N   F   N   P   G ggcggtgcggattggactcagttggacggcgcgttcagttggtatgcttggccaaccgac
 G   G   A   D   W   T   Q   L   D   G   A   F   S   W   Y   A   W   P   T   D ggttccaacaaccctccttcctccaccagcacctacctgcccacctatgccgacaccgac
 G   S   N   N   P   P   S   S   T   S   T   Y   L   P   T   Y   A   D   T   D tacaccaccaagctgggcggcgacaagacgaaatacgtagccccgtgtcgccctggttc
 Y   T   T   K   L   G   G   D   K   T   K   Y   V   A   P   V   S   P   W   F ttcacgcactacggcagcgaggtgtccttcggccccaagaactatctcttccctccgag
 F   T   H   Y   G   S   E   V   S   F   G   P   K   N   Y   L   F   P   S   E ttcctctggttcacgcgctggcaagagatccttgacctcgggtcgcgcttcgtcgaaatc
 F   L   W   F   T   R   W   Q   E   I   L   D   L   G   S   R   F   V   E   I atcacctggaacgactacggcgagtcgcactacatcggcccgctctcctccccgcactac
 I   T   W   N   D   Y   G   E   S   H   Y   I   G   P   L   S   S   P   H   Y
```

```
-continued
gacgacggcaacagcaaatggaccaacgacatgccgcacaacggctgggccgacctcgcc
 D  D  G  N  S  K  W  T  N  D  M  P  H  N  G  W  A  D  L  A gccccctacatcgccgcctacaaagccggcgccacctcgcccacctcctacatcaccact
 A  P  Y  I  A  A  Y  K  A  G  A  T  S  P  T  S  Y  I  T  T gacaggctggtctactggttccgcccgcagccgaaaggcctcgactgcgcctcgaccgac
 D  R  L  V  Y  W  F  R  P  Q  P  K  G  L  D  C  A  S  T  D aacgtcggcgccgcgccctctggcgccgacctcgtcgccgacaagctgttcgtcgtgacg
 N  V  G  A  A  P  S  G  A  D  L  V  A  D  K  L  F  V  V  T atgctgacggacgccgcgaacgtgacggtcggatcgggcggcgatgccacgcagacgttc
 M  L  T  D  A  A  N  V  T  V  G  S  G  G  D  A  T  Q  T  F gccgcgccgaagggcgtcgccagctttacggtgccgctggccgtgggcgtgcaggcgttc
 A  A  P  K  G  V  A  S  F  T  V  P  L  A  V  G  V  Q  A  F gcggtcgagcgcggcggcgtcgccgtcgacggcctaggcgggcaggcgccgaagcaggtc
 A  V  E  R  G  G  V  A  V  D  G  L  G  G  Q  A  P  K  Q  V agcggcgagtgtgtgtgcgggctgtacaacttcaatgcgttcgtcggcacccctgccggtc
 S  G  E  C  V  C  G  L  Y  N  F  N  A  F  V  G  T  L  P  V gcggagcagggcgacgcgttgcaggccgatgggctgagcaggttcaccgagggcttgaag
 A  E  Q  G  D  A  L  Q  A  D  G  L  S  R  F  T  E  G  L  K gtcgcgacgtgcagtccgacgccgacgttggccgccaggcggtga
 V  A  T  C  S  P  T  P  T  L  A  A  R  R  -

SEQ ID NO: 219
LENGTH: 494
TYPE: PRT
ORGANISM: M. phaseolina
MRWASTLLPSATGALLFAALANGAPAVGSAATPTLKERQTSDRLVFAHFMIGISTDRTSSADYDADILRAKSL

GIDAFALNFGPDTASANYSQQLVYAYESAANNGFSVFLSFDFNTGLWDTADAAAVGARIAAFGSRGGQLKVDD

KAFVSSFVGDALDVSAVRTAAGIDIFFAPNFNPGGGADWTQLDGAFSWYAWPTDGSNNPPSSTSTYLPTYADT

DYTTKLGGDKTKYVAPVSPWFFTHYGSEVSFGPKNYLFPSEFLWFTRWQEILDLGSRFVEIITWNDYGESHYI

GPLSSPHYDDGNSKWTNDMPHNGWADLAAPYIAAYKAGATSPTSYITTDRLVYWFRPQPKGLDCASTDNVGAA

PSGADLVADKLFVVTMLTDAANVTVGSGGDATQTFAAPKGVASFTVPLAVGVQAFAVERGGVAVDGLGGQAPK

QVSGECVCGLYNFNAFVGTLPVAEQGDALQADGLSRFTEGLKVATCSPTPTLAARR*

SEQ ID NO: 220
LENGTH: 1948 (including 150 bp 5' UTR and 150 bp 3' UTR)
TYPE: DNA
ORGANISM: M. phaseolina
CACGAGACTCTCACTAATCTCCACTTCAAGGGTCAGTCTCTGCTCAACTCCTCTGCTCTGACTTTTTTTTAT GCGCCCTCATTCTGCATTTTTTTTTTtCGGGTGTTGCTGTTTGTCTTCGTTGCTTTCTGACTTTGCGCACTGT

CAACATGCGTGCTCACACTCTGCAGTGCTTGGCAGCAGCCGCAGCAGCTTTGCTTTATGGCAGCCAAGTCGTT

GCTGAAGACCCCAAAGCAGTGTTTGCTCATTACATGGTTTGTCGCTTCGCTCACACTGCCAAAGGGTTCTCTG

CTGACAGGCATTCCAGGTCGGCACAATAAACGAGGATCATGTCCATCAAGATGTCGACGATGCCGCCGCCATG

GGGCTAGACGGCTTCGCGCTCAACATGGGAAGTCCTTTGGAACCGTTCTCTCGCGCCGTGTTCGACTACATGT

TTGATTACACCCGCGACAACCATCCCGACTTCAAGCTATTCATAAGTATGGATCTCTGGTCCGCAAAGAACCT

GTCCGACTTCGATCAGTTCTTCACCGACTTTCTGGCCCACGATGCCTATTACAAAGGTCCCAACGGATTCCCT

TTCGTCAGCACCTATGGCAACGGTGGATTCTCCAAGGAAACATGGCAAGACTGGAAGAATAGGTGGGCGGACA

AGCTCTACTTTGTACCCGATTTTGCCGGCATGGCAGGGACAGATGATTCCTCTCCTGAGTGGTGGGAGGACTG

GGGGGACATCGTCGACGGCCTATTCAGCTGGGAATCGGTATGGCCCGTCCAGAACCAGACCAACACCCTGAGC

ATCGCTGCAGACGACAAGCACATGGCCGCTGCCTCCCAGAACAACAAGACATACATGATCGGTAGGTCAACCC

TGAGGCTTCCCTCTCTCGCCTCAGCTACTGATATACCTCCCTCCACGTAGGTCTCAGCATGCTCCAATACAAA

AACTCCTACGGCGCCAACCTGTACCGCGCCGGCGAGGAGAACCTTTCTAACCGCATCCACAACATCCTCAACA

TGACGACCAAGCCCGCCTTCGCGCAGCTGCTCACCTGGAACGACGGGCCCGAATCCCACTACATCGGCACCAT
```

```
CTGGCCCGAGCAGAACAACGACACCATCCCCTCCGTCTACGCCTCCCAATCCGCCGCCTCCCACACCGGCATC

CAATCCGTTCTCACGAGCTTCATCGACGCCTACAAAAAGGACCTCCCcTCCCCCGACATGCAGCCGCAGGAAG

ACAAGCAGGCTGTCGGCGCGCTGTGGTACAAGCCCATCCTCTCCAACACCGTCTGCGCCAACGAGATGAGCGG

CGAGCTGCACGACGCCAAGCCTGACGGCTACGAAGTCGCCGCCGATGTCTCCGCCTGGGCCGTCGTCGTCGCC

GCCGATGCCGAGGCCGACGACCTCACCCTGCGCGGGTACAGCGGCGGCGAGAAGCTCGGCGAGGTGGCGCTCG

TGCCCGGGCTCAACTTCGGCAATTTCAGCACGCTGAAGGAGGGAAAGCAGTGCATGGAAGTCAGGAATGGACA

GGGGAGGCTCGTGCTCGTCGCCAGTGGTGGCAGGGACGTCACGAGTGATTGTCCTGACGGGATTTTCAATCTT

AATCCGCAGATTTTGGAACTGGGCGAGGACGTCAGCCAAGGGGGCTGTACCGGGGGCGATGATGATGGCGATG

CGAGCGGAAGTGGTGATGGTGACGGTGAGGAGAGTTGGGGTGTCAGAGGCACCATGCTGGATAAGTGGCGGTT

GGTGGCGGCGTTGATGGTGTCGTCGGCGGTGGTGTGGCTGTGGTGAGTAGTGCGTCGGGAATTTTTCCCGTTG

CTTTTGATGAAGATATGATTATGCGGTTATGATTATTTACTCCCTCTGCTTGGAACGGCGGTGGAAAGGGGAA

AAGTATGATTAAGGGCAGGCATTTGGTATGAGCTCTGCTTCTTGTTTATT

SEQ ID NO: 221
LENGTH: 1533
TYPE: DNA
ORGANISM: M. phaseolina
FEATURE NAME/KEY: CDS
LOCATION: (1)...(1533)
atgcgtgctcacactctgcagtgcttggcagcagccgcagcagctttgctttatggcagc
 M  R  A  H  T  L  Q  C  L  A  A  A  A  A  L  L  Y  G  S caagtcgttgctgaagaccccaaagcagtgtttgctcattacatggtcggcacaataaac
 Q  V  V  A  E  D  P  K  A  V  F  A  H  Y  M  V  G  T  I  N gaggatcatgtccatcaagatgtcgacgatgccgccgccatgggctagacggcttcgcg
 E  D  H  V  H  Q  D  V  D  D  A  A  A  M  G  L  D  G  F  A ctcaacatgggaagtccttttggaaccgttctctcgcgccgtgttcgactacatgtttgat
 L  N  M  G  S  P  L  E  P  F  S  R  A  V  F  D  Y  M  F  D tacacccgcgacaaccatcccgacttcaagctattcataagtatggatctctggtccgca
 Y  T  R  D  N  H  P  D  F  K  L  F  I  S  M  D  L  W  S  A aagaacctgtccgacttcgatcagttcttcaccgactttctggcccacgatgcctattac
 K  N  L  S  D  F  D  Q  F  F  T  D  F  L  A  H  D  A  Y  Y aaaggtcccaacggattccctttcgtcagcacctatggcaacggtggattctccaaggaa
 K  G  P  N  G  F  P  F  V  S  T  Y  G  N  G  G  F  S  K  E acatggcaagactggaagaataggtgggcggacaagctctactttgtacccgattttgcc
 T  W  Q  D  W  K  N  R  W  A  D  K  L  Y  F  V  P  D  F  A ggcatggcagggacagatgattcctctcctgagtggtgggaggactggggggacatcgtc
 G  M  A  G  T  D  D  S  S  P  E  W  W  E  D  W  G  D  I  V gacggcctattcagctgggaatcggtatggcccgtccagaaccagaccaacaccctgagc
 D  G  L  F  S  W  E  S  V  W  P  V  Q  N  Q  T  N  T  L  S atcgctgcagacgacaagcacatggccgctgcctcccagaacaacaagacatacatgatc
 I  A  A  D  D  K  H  M  A  A  A  S  Q  N  N  K  T  Y  M  I ggtctcagcatgctccaatacaaaaactcctacggcgccaacctgtaccgcgccggcgag
 G  L  S  M  L  Q  Y  K  N  S  Y  G  A  N  L  Y  R  A  G  E gagaacctttctaaccgcatccacaacatcctcaacatgacgaccaagcccgccttcgcg
 E  N  L  S  N  R  I  H  N  I  L  N  M  T  T  K  P  A  F  A cagctgctcacctggaacgacgggccgaatcccactacatcggcaccatctggcccgag
 Q  L  L  T  W  N  D  G  P  E  S  H  Y  I  G  T  I  W  P  E cagaacaacgacaccatcccctccgtctacgcctcccaatccgccgcctcccacaccggc
 Q  N  N  D  T  I  P  S  V  Y  A  S  Q  S  A  A  S  H  T  G atccaatccgttctcacgagcttcatcgacgcctacaaaaaggacctccctccccgac
 I  Q  S  V  L  T  S  F  I  D  A  Y  K  K  D  L  P  S  P  D atgcagccgcaggaagacaagcaggctgtcggcgcgctgtggtacaagcccatcctctcc
 M  Q  P  Q  E  D  K  Q  A  V  G  A  L  W  Y  K  P  I  L  S
```

```
aacaccgtctgcgccaacgagatgagcggcgagctgcacgacgccaagcctgacggctac
 N  T  V  C  A  N  E  M  S  G  E  L  H  D  A  K  P  D  G  Y gaagtcgccgccgatgtctccgcctgggccgtcgtcgtcgccgccgatgccgaggccgac
 E  V  A  A  D  V  S  A  W  A  V  V  V  A  A  D  A  E  A  D gacctcaccctgcgcgggtacagcggcggcgagaagctcggcgaggtggcgctcgtgccc
 D  L  T  L  R  G  Y  S  G  G  E  K  L  G  E  V  A  L  V  P gggctcaacttcggcaatttcagcacgctgaaggagggaaagcagtgcatggaagtcagg
 G  L  N  F  G  N  F  S  T  L  K  E  G  K  Q  C  M  E  V  R aatggacaggggaggctcgtgctcgtcgccagtggtggcagggacgtcacgagtgattgt
 N  G  Q  G  R  L  V  L  V  A  S  G  G  R  D  V  T  S  D  C cctgacgggattttcaatcttaatccgcagatttttggaactgggcgaggacgtcagccaa
 P  D  G  I  F  N  L  N  P  Q  I  L  E  L  G  E  D  V  S  Q gggggctgtaccggggcgatgatgatggcgatgcgagcggaagtggtgatggtgacggt
 G  G  C  T  G  G  D  D  D  G  D  A  S  G  S  G  D  G  D  G gaggagagttggggtgtcagaggcaccatgctggataagtggcggttggtggcggcgttg
 E  E  S  W  G  V  R  G  T  M  L  D  K  W  R  L  V  A  A  L atggtgtcgtcggcggtggtgtggctgtggtga
 M  V  S  S  A  V  V  W  L  W  -

SEQ ID NO: 222
LENGTH: 510
TYPE: PRT
ORGANISM: M. phaseolina
MRAHTLQCLAAAAAALLYGSQVVAEDPKAVFAHYMVGTINEDHVHQDVDDAAAMGLDGFALNMGSPLEPFSRA

VFDYMFDYTRDNHPDFKLFISMDLWSAKNLSDFDQFFTDFLAHDAYYKGPNGFPFVSTYGNGGFSKETWQDWK

NRWADKLYFVPDFAGMAGTDDSSPEWWEDWGDIVDGLFSWESVWPVQNQTNTLSIAADDKHMAAASQNNKTYM

IGLSMLQYKNSYGANLYRAGEENLSRIHNILNMTTKPAFAQLLTWNDGPESHYIGTIWPEQNNDTIPSVYAS

QSAASHTGIQSVLTSFIDAYKKDLPSPDMQPQEDKQAVGALWYKPILSNTVCANEMSGELHDAKPDGYEVAAD

VSAWAVVVAADAEADDLTLRGYSGGEKLGEVALVPGLNFGNFSTLKEGKQCMEVRNGQGRLVLVASGGRDVTS

DCPDGIFNLNPQILELGEDVSQGGCTGGDDDGDASGSGDGDGEESWGVRGTMLDKWRLVAALMVSSAVVWLW*

SEQ ID NO: 223
LENGTH: 1699 (including 150 bp 5' UTR and 150 bp 3' UTR)
TYPE: DNA
ORGANISM: M. phaseolina
GCTATTTTGGGTAACCCTGATGCCGAAAAATGGACTGCGACCTCGCTACGGCTCTCATATAAATTCTGCCAGA

AAGTTCCTGCAACTTTCTTGCTCCATCAGCTCGTCCAGCTCTCATCCCCCTCAAGAAGCTGCCAGTAACTTCC

CGCCATGAAGCTTTCCACCATCTTTGCCACTCTGGCTGCTCTGGCCGGCGAGGCCACTGCCAAAGCTGTCTTC

GCTCACTTCATGGTATGCATCCGTCCACGAACCTGAATTAGTCAGTCCTGAGCTAAGAACTATACAGGTCGGC

AACGTCATAAACAATTACGACGTTGACAAGTGGACGAGCGATATCAAGCTTGCCCAGGCCTCCGGCATCGATG

GCTTCGTCCTCAACATCACCCCGCCCTTGAACGAGGCTTTGCGGACTCAGATCGCTGCCGCCTTCATTGCAGC

GAATAACCTGAAGAGCGAGTGGAAGAACTTCTTCTCCTTCGACTACTTAGGTAACGGGATCCCGTGGAACGCT

GCCGACATTGCCTCTCTCATGAAGGAGTACGGACCGAATTACGCCTATCAGAAGGCCTCCAGAAACGGCGTGA

GCCTGCCTTTCGTTTCGACCTTCGAGGGCGGCGACCACGCCGGTGATTGGGCCTCCATCAAGTCTCAAGTTGA

CGTCTATCTCGTGCCCGATTGGACCGGCTCGGGCGCTGATGTGGTGAAGGCAAACATCAACGCGGGCGCCAGC

ATTGACGGCTTTTTCAGCTGGGACATGTGGCCCGAAGGTGCTAACGACATGAGCACCACGCCTGACAAGAGCT

GGCAGTCCACCATTGGCGACAAGGACTATATGATGGGCGTCTCACCCTGGTTCTTCACCGACCTCAAGGGCTA

TGGGAAGCAGCGCCTCTGGCGCGGCGACGACCTCTGGGCCGACCGCTGGGAGCAAGTCCAGCAAGTCAACCCC

GAGTGGGTCGAGATCGTTACCTGGAACGACTACGGCGAGTCTCACTACATCGGCCCCATCTGGGAAGCCGGCA

TTCCACAGGACGCCTCCGCCAACGCCGACGCCCGCTGGTACGTCGAGGGCTACGGCACCAGCACTGGCGCGA

TCTCCTCCCTTACTACATCGCCCGCTACAAGAACGGCAGCCCGCCCGCAGTGACCCAGGAGAAGCTCACCTGG
```

```
TGGTACCGCCTCTCTCCCAAGGCAGCCGGCACTACCCAGGTTACCGGCAACGATTGCTCCTACCAGCCCTGCC

TTGACCCCAACGCCATTGTTCAGGATGAGATCTTCTTCACCGCGCTGATCAGCGACCCTGCCAACACCAACAT

CGTTGTCCAGGTCGGCGACAACACGCCTGTATCCCACCCCGCCACCGCCGTCGGCATCAACCATTTCTCGCAG

CCCTTCAACGGACAGTACGGCAACGTGACTTTTTCGATTGTGAGGAACGGAAGGGGCGTTCTTTCGGGTACGG

GCTACGCAATCACAGCTCAGCCGCCGAACGGAAAGAGGAACTACAACGCGTATGTCGGTGGTGTTCCGGATAC

CTACGCAAGCTTGTGAGCCATCTCCAAACGAGGGCAAGAGGATGGCCAGAAAGAAAGAATGTATATATGCGTG

ATCCAGAGGAATTAGAAAGGACATTCGCTACATAGACCAATGAATACAAGGCAAGCCTTGCCAATTTTGCCAA

TGAGCTTGGAAGCTTTGTGG

SEQ ID NO: 224
LENGTH: 1344
TYPE: DNA
ORGANISM: M. phaseolina
FEATURE NAME/KEY: CDS
LOCATION: (1)...(1344)
atgaagctttccaccatctttgccactctggctgctctggccggcgaggccactgccaaa
 M  K  L  S  T  I  F  A  T  L  A  A  L  A  G  E  A  T  A  K gctgtcttcgctcacttcatggtcggcaacgtcataaacaattacgacgttgacaagtgg
 A  V  F  A  H  F  M  V  G  N  V  I  N  N  Y  D  V  D  K  W acgagcgatatcaagcttgcccaggcctccggcatcgatggcttcgtcctcaacatcacc
 T  S  D  I  K  L  A  Q  A  S  G  I  D  G  F  V  L  N  I  T ccgcccttgaacgaggctttgcggactcagatcgctgccgccttcattgcagcgaataac
 P  P  L  N  E  A  L  R  T  Q  I  A  A  A  F  I  A  A  N  N ctgaagagcgagtggaagaacttcttctccttcgactacttaggtaacgggatcccgtgg
 L  K  S  E  W  K  N  F  F  S  F  D  Y  L  G  N  G  I  P  W aacgctgccgacattgcctctctcatgaaggagtacggaccgaattacgcctatcagaag
 N  A  A  D  I  A  S  L  M  K  E  Y  G  P  N  Y  A  Y  Q  K gcctccagaaacggcgtgagcctgcctttcgtttcgaccttcgagggcggcgaccacgcc
 A  S  R  N  G  V  S  L  P  F  V  S  T  F  E  G  G  D  H  A ggtgattgggcctccatcaagtctcaagttgacgtctatctcgtgcccgattggaccggc
 G  D  W  A  S  I  K  S  Q  V  D  V  Y  L  V  P  D  W  T  G tcgggcgctgatgtggtgaaggcaaacatcaacgcgggcgccagcattgacggcttttc
 S  G  A  D  V  V  K  A  N  I  N  A  G  A  S  I  D  G  F  F agctgggacatgtggcccgaaggtgctaacgacatgagccaccacgcctgacaagagctgg
 S  W  D  M  W  P  E  G  A  N  D  M  S  T  T  P  D  K  S  W cagtccaccattggcgacaaggactatatgatgggcgtctcaccctggttcttcaccgac
 Q  S  T  I  G  D  K  D  Y  M  M  G  V  S  P  W  F  F  T  D ctcaagggctatgggaagcagcgcctctggcgcggcgacgacctctgggccgaccgctgg
 L  K  G  Y  G  K  Q  R  L  W  R  G  D  D  L  W  A  D  R  W gagcaagtccagcaagtcaaccccgagtgggtcgagatcgttacctggaacgactacggc
 E  Q  V  Q  Q  V  N  P  E  W  V  E  I  V  T  W  N  D  Y  G gagtctcactacatcggccccatctgggaagccggcattccacaggacgcctccgccaac
 E  S  H  Y  I  G  P  I  W  E  A  G  I  P  Q  D  A  S  A  N gccgacgcccgctggtacgtcgagggctacggccaccagcactggcgcgatctcctccct
 A  D  A  R  W  Y  V  E  G  Y  G  H  Q  H  W  R  D  L  L  P tactacatcgcccgctacaagaacggcagcccgcccgcagtgacccaggagaagctcacc
 Y  Y  I  A  R  Y  K  N  G  S  P  P  A  V  T  Q  E  K  L  T tggtggtaccgcctctctcccaaggcagccggcactacccaggttaccggcaacgattgc
 W  W  Y  R  L  S  P  K  A  A  G  T  T  Q  V  T  G  N  D  C tcctaccagccctgccttgaccccaacgccattgttcaggatgagatcttcttcaccgcg
 S  Y  Q  P  C  L  D  P  N  A  I  V  Q  D  E  I  F  F  T  A ctgatcagcgaccctgccaacaccaacatcgttgtccaggtcggcgacaacacgcctgta
 L  I  S  D  P  A  N  T  N  I  V  V  Q  V  G  D  N  T  P  V tcccaccccgccaccgccgtcggcatcaaccatttctcgcagcccttcaacggacagtac
 S  H  P  A  T  A  V  G  I  N  H  F  S  Q  P  F  N  G  Q  Y
```

```
ggcaacgtgacttttcgattgtgaggaacggaagggcgttctttcgggtacgggctac
 G   N   V   T   F   S   I   V   R   N   G   R   G   V   L   S   G   T   G   Y gcaatcacagctcagccgccgaacggaaagaggaactacaacgcgtatgtcggtggtgtt
 A   I   T   A   Q   P   P   N   G   K   R   N   Y   N   A   Y   V   G   G   V ccggatacctacgcaagcttgtga
 P   D   T   Y   A   S   L   -
```

SEQ ID NO: 225
LENGTH: 447
TYPE: PRT
ORGANISM: M. phaseolina
MKLSTIFATLAALAGEATAKAVFAHFMVGNVINNYDVDKWTSDIKLAQASGIDGFVLNITPPLNEALRTQIAA

AFIAANNLKSEWKNFFSFDYLGNGIPWNAADIASLMKEYGPNYAYQKASRNGVSLPFVSTFEGGDHAGDWASI

KSQVDVYLVPDWTGSGADVVKANINAGASIDGFFSWDMWPEGANDMSTTPDKSWQSTIGDKDYMMGVSPWFFT

DLKGYGKQRLWRGDDLWADRWEQVQQVNPEWVEIVTWNDYGESHYIGPIWEAGIPQDASANADARWYVEGYGH

QHWRDLLPYYIARYKNGSPPAVTQEKLTWWYRLSPKAAGTTQVTGNDCSYQPCLDPNAIVQDEIFFTALISDP

ANTNIVVQVGDNTPVSHPATAVGINHFSQPFNGQYGNVTFSIVRNGRGVLSGTGYAITAQFPNGKRNYNAYVG

GVPDTYASL*

SEQ ID NO: 226
LENGTH: 1767 (including 150 bp 5' UTR and 150 bp 3' UTR)
TYPE: DNA
ORGANISM: M. phaseolina
AGTTTCAGCTTCACCTTCGGCTGGTACCTCTCTCAACACATCCGTCACTGGACTGACGCGGCAGCGGTGCATA

ACCCTTCCTTTGCTACACCCATTGCTCCTTCGAGGGCTGTCCGATCCTTTTTTGAGTAGTCACTCCTTGCTTG

CATCATGCGTTCCTTCTCCAGCTATCTGGTCGCTCTGGCCACGGCATCCCTGGGCCTTGTCGCCAGCGTCAAT

GCCGATTCCAAGGGTGTCTTTGCCCACTACATGGTGTGTCTCGAGCCATCCGGCCCAGCTTGCACTCTTGCTG

ACATAAGCCAGGTGTGCGGTCTCTCGTCCGTCGAGCAGGCTCAGACCGACGTCCGCGACGCCAAGAATCTCGG

TGTTGATGCCTTTGCTCTGAATGTCCAGAATGTCGTCGACTCCTGGGCAACCGGCGCCATTGAGTACCTCTTC

ACTGCCGCAGCCCAGAATGACTTCCACCTGTTCTTTTCCTTCGACATGGCCGTCCTGAACGAGCAGGATCCCA

CCTCCTTCCTTCCCATCTTCGAGCAGTATGCTTCAAACGACACTTACTACAAGCACGATGGCAAGCCTTTCGT

TTCCACCTTCAACGGCGGCATCATGCAGAACGGCGGCGAGTGGACCAGGAAGTTCCGCGAGGCGATTGAGGCC

GACAACATTACCCCCTACTTCGTCTCCGACTTTGGCCTCTACAGCAGCTCCAGCGCTTCTGCTAGCGAGAGCA

TCATGGGTTCCCTGAGCACCTATTCTGCCGTCGACGGTGTCTTCAGCTGGGAGACTGCCTGGCCCTCCCAGAA

CGATGGCCTTGCCAGCATCCTCAGCTCCGTCACCGACAAGGTCGGCTCGGACGCTGCCCATGCTACCGGCAAG

TCCTACTTGATGCGTACGTCCACCTCGTCTCCCTAACCACCGCTCTCCGCTGACTCCGCCACAGCTCTCTCCT

CCCACCAGTTCAAGCACATTGACGGCCTTGGCAACTGGTACCGCCGCGGCGAACTCACCCTCCCGAACCGCAT

GAAGCAGATCCTCGAGCTCTCTCCCGAGTTCGTCATGCTTCTCACCTGGAACGATGCCGGCGAGTCGCACTAC

ATCGGCAACGTCTGGCAAGAGTCCATCTCGACCTCGGAGGCCACCAAGAAATACGTCGACGATTTTGACCACT

CGGCCTGGCAGGACGTCATCTCGCCCTTCATCTCCGCATACAAGAACGACGCCAAGGATGAGACCGAGATCCT

GCCTCTCAACAACGGCAACTTCACCGGCGCCATGTGGTACCGTCCCCTGCTCAAGGATGCCTCTTGCTCCGGT

GACTACCTCGGCAAGCCCATCGGCTGGGAGAACGCGCAGGACACCGTCAACTTCGCCATCGTGCTGCCCGCCG

AGACTTCCGGCGTTAAGATCAATGTGTACAGCGGCGACACCCTCCTCAAGTCGTTCGACGGCAAGGCCGGCAT

GAACGCCCAGGCCGTCCAGGGCATGCGGCGGGTGCGCAGAAGGTCGAGGTAGTGGGTGCGGATGGCAACGTG

ATCGGCGCGGGCTTGAGCAAGGTGGATGTCGCCGCGGATGCTGACTTTTGCAACTTCAACTATCACGTCGTCC

ACGTGGCGTAAGGAACAGGCGCAACATGGGATGATGTCTGATACCCCCTGTTTTTTTTAGACTTCTTACATTC

GTTTCTGCTGGTTCCCCAAATGGGGATACCTGCTTTTCTTTTCATTTCTCCAACTCAAGAATTCTAGACTTTT

ACATTTTACTCTTCT

SEQ ID NO: 227
LENGTH: 1365
TYPE: DNA
ORGANISM: M. phaseolina
FEATURE NAME/KEY: CDS
LOCATION: (1)...(1365)

```
atgcgttccttctccagctatctggtcgctctggccacggcatccctgggccttgtcgcc
 M   R   S   F   S   S   Y   L   V   A   L   A   T   A   S   L   G   L   V   A agcgtcaatgccgattccaagggtgtctttgccactacatggtgtgcggtctctcgtcc
 S   V   N   A   D   S   K   G   V   F   A   H   Y   M   V   C   G   L   S   S gtcgagcaggctcagaccgacgtccgcgacgccaagaatctcggtgttgatgcctttgct
 V   E   Q   A   Q   T   D   V   R   D   A   K   N   L   G   V   D   A   F   A ctgaatgtccagaatgtcgtcgactcctgggcaaccggcgccattgagtacctcttcact
 L   N   V   Q   N   V   V   D   S   W   A   T   G   A   I   E   Y   L   F   T gccgcagcccagaatgacttccacctgttcttttccttcgacatggccgtcctgaacgag
 A   A   A   Q   N   D   F   H   L   F   F   S   F   D   M   A   V   L   N   E caggatcccacctccttccttcccatcttcgagcagtatgcttcaaacgacacttactac
 Q   D   P   T   S   F   L   P   I   F   E   Q   Y   A   S   N   D   T   Y   Y aagcacgatggcaagccttcgtttccaccttcaacggcggcatcatgcagaacggcggc
 K   H   D   G   K   P   F   V   S   T   F   N   G   G   I   M   Q   N   G   G gagtggaccaggaagttccgcgaggcgattgaggccgacaacattaccccctacttcgtc
 E   W   T   R   K   F   R   E   A   I   E   A   D   N   I   T   P   Y   F   V tccgactttggcctctacagcagctccagcgcttctgctagcgagagcatcatgggttcc
 S   D   F   G   L   Y   S   S   S   S   A   S   A   S   E   S   I   M   G   S ctgagcacctattctgccgtcgacggtgtcttcagctgggagactgcctggccctcccag
 L   S   T   Y   S   A   V   D   G   V   F   S   W   E   T   A   W   P   S   Q aacgatggccttgccagcatcctcagctccgtcaccgacaaggtcggctcggacgctgcc
 N   D   G   L   A   S   I   L   S   S   V   T   D   K   V   G   S   D   A   A catgctaccggcaagtcctacttgatgcctctctcctcccaccagttcaagcacattgac
 H   A   T   G   K   S   Y   L   M   P   L   S   S   H   Q   F   K   H   I   D ggccttggcaactggtaccgccgcggcgaactcaccctcccgaaccgcatgaagcagatc
 G   L   G   N   W   Y   R   R   G   E   L   T   L   P   N   R   M   K   Q   I ctcgagctctctcccgagttcgtcatgcttctcacctggaacgatgccggcgagtcgcac
 L   E   L   S   P   E   F   V   M   L   L   T   W   N   D   A   G   E   S   H tacatcggcaacgtctggcaagagtccatctcgacctcggaggccaccaagaaatacgtc
 Y   I   G   N   V   W   Q   E   S   I   S   T   S   E   A   T   K   K   Y   V gacgattttgaccactcggcctggcaggacgtcatctcgcccttcatctccgcatacaag
 D   D   F   D   H   S   A   W   Q   D   V   I   S   P   F   I   S   A   Y   K aacgacgccaaggatgagaccgagatcctgcctctcaacaacggcaacttcaccggcgcc
 N   D   A   K   D   E   T   E   I   L   P   L   N   N   G   N   F   T   G   A atgtggtaccgtcccctgctcaaggatgcctcttgctccggtgactacctcggcaagccc
 M   W   Y   R   P   L   L   K   D   A   S   C   S   G   D   Y   L   G   K   P atcggctgggagaacgcgcaggacaccgtcaacttcgccatcgtgctgcccgccgagact
 I   G   W   E   N   A   Q   D   T   V   N   F   A   I   V   L   P   A   E   T tccggcgttaagatcaatgtgtacagcggcgacaccctcctcaagtcgttcgacggcaag
 S   G   V   K   I   N   V   Y   S   G   D   T   L   L   K   S   F   D   G   K gccggcatgaacgcccaggccgtccagggcatgcgggcgggtgcgcagaaggtcgaggta
 A   G   M   N   A   Q   A   V   Q   G   M   R   A   G   A   Q   K   V   E   V gtgggtgcggatggcaacgtgatcggcgcgggcttgagcaaggtggatgtcgccgccgat
 V   G   A   D   G   N   V   I   G   A   G   L   S   K   V   D   V   A   A   D gctgacttttgcaacttcaactatcacgtcgtccacgtggcgtaa
 A   D   F   C   N   F   N   Y   H   V   V   H   V   A   -
```

SEQ ID NO: 228
LENGTH: 454
TYPE: PRT
ORGANISM: M. phaseolina
MRSFSSYLVALATASLGLVASVNADSKGVFAHYMVCGLSSVEQAQTDVRDAKNLGVDAFALNVQNVVDSWATG

AIEYLFTAAAQNDFHLFFSFDMAVLNEQDPTSFLPIFEQYASNDTYYKHDGKPFVSTFNGGIMQNGGEWTRKF

REAIEADNITPYFVSDFGLYSSSSASASESIMGSLSTYSAVDGVFSWETAWPSQNDGLASILSSVTDKVGSDA

AHATGKSYLMPLSSHQFKHIDGLGNWYRRGELTLPNRMKQILELSPEFVMLLTWNDAGESHYIGNVWQESIST

SEATKKYVDDFDHSAWQDVISPFISAYKNDAKDETEILPLNNGNFTGAMWYRPLLKDASCSGDYLGKPIGWEN

AQDTVNFAIVLPAETSGVKINVYSGDTLLKSFDGKAGMNAQAVQGMRAGAQKVEVVGADGNVIGAGLSKVDVA

ADADFCNFNYHVVHVA*

SEQ ID NO: 229
LENGTH: 1065 (including 150 bp 5' UTR and 150 bp 3' UTR)
TYPE: DNA
ORGANISM: M. phaseolina
GGTGGTGTTGCTGCCTCAGCGGAACCCGCCGGCCATCACTCGCCAAGTCCGTGGCCATGGAGGTGTGTGGGAG

CACTCGAGGAGCTGTACAAAAGGCGATACTACATCCGTTCATATTGCCATCAAGCAAACGATCTCCTATTCAT

CATCATGGCTCTCAATCGCGGCTTCATGGCTGCGTTAGCATCCTTTCTTGTCCTCACTACCGCAGATTTGGGA

GCGGCTAAGGCCGTAACTAGGGGTGTCTTTGCAAAATACATGGTTGGAAACGTGTACGAAGACCATGCTCACC

AAGACATCAAAGATGCTTCAGCCATGGGCCTTGACGGATTCGCCCTGAACATTGGCGACCCCTCCCAAGATTT

CGTACGCCAGACGCTGAACTACATGTTCGACTACGCCCGCGACAACTACCCCGACTTCAAGCTCTTCATCAGC

ATGGATCTTTGGGCCGCCGGCTCCGCCAAGAAAGGCTTGAATGACTTCGTCGGTATCCTTAGGGACTACATGG

GTCATGGAGCTTACTACAAACGCCCAAATGGGTATCCCTTTATTAGCACCTTTGCCGATGGCGGCCTCGAAAA

CACGACATGGATGGACTGGAGGAACAAGTGGGCAAACGAAATTTACTTCGTACCCGACTTTGGCGGCTCAAAA

GCCTACTGCCTGTCTGACCCTGGCTGGTGGGAGTACTGGGGAGATGTTGTCGATGGCATCTTCAGCTGGGAAT

CTACTTGGCCTCTGCGAGGCAGCACTCAAACATCTTACTGGAAGAACGAGACGTGGATTTCGTCCACGTGCAG

CTTCCACCGACTAACATTCGGCTTTCTAGGCTTGAGCATGCTGCAATACGAGAACTCGGTGGGTTTTTGCTC

CGACTTGAGCCTCAAGCGCTGACCACGTGGTCGATATAGCATGAGACGAATCTATACCGAGCTTTTTTTTtAA

AGCAATATTCTTTTTGAAGAAAAGGAAGAGTTCTATTTAAAAGCAAACTATTAGTTATAGTTAAAAAATAATT

TTAAAGAATAACTAACCTTTTTAGTAGAAGCTTTCTTCCCTTA

SEQ ID NO: 230
LENGTH: 765
TYPE: DNA
ORGANISM: M. phaseolina
FEATURE NAME/KEY: CDS
LOCATION: (1)...(765)
atggctctcaatcgcggcttcatggctgcgttagcatcctttcttgtcctcactaccgca
 M   A   L   N   R   G   F   M   A   A   L   A   S   F   L   V   L   T   T   A gatttgggagcggctaaggccgtaactaggggtgtctttgcaaaatacatggttggaaac
 D   L   G   A   A   K   A   V   T   R   G   V   F   A   K   Y   M   V   G   N gtgtacgaagaccatgctcaccaagacatcaaagatgcttcagccatgggccttgacgga
 V   Y   E   D   H   A   H   Q   D   I   K   D   A   S   A   M   G   L   D   G ttcgccctgaacattggcgacccctcccaagatttcgtacgccagacgctgaactacatg
 F   A   L   N   I   G   D   P   S   Q   D   F   V   R   Q   T   L   N   Y   M ttcgactacgcccgcgacaactaccccgacttcaagctcttcatcagcatggatctttgg
 F   D   Y   A   R   D   N   Y   P   D   F   K   L   F   I   S   M   D   L   W gccgccggctccgccaagaaaggcttgaatgacttcgtcggtatccttagggactacatg
 A   A   G   S   A   K   K   G   L   N   D   F   V   G   I   L   R   D   Y   M ggtcatggagcttactacaaacgcccaaatgggtatccctttattagcacctttgccgat
 G   H   G   A   Y   Y   K   R   P   N   G   Y   P   F   I   S   T   F   A   D ggcggcctcgaaaacacgacatggatggactggaggaacaagtgggcaaacgaaatttac
 G   G   L   E   N   T   T   W   M   D   W   R   N   K   W   A   N   E   I   Y -continued

```
ttcgtacccgactttggcggctcaaaagcctactgctgtctgaccctggctggtgggag
 F  V  P  D  F  G  G  S  K  A  Y  C  L  S  D  P  G  W  W  E tactggggagatgttgtcgatggcatcttcagctgggaatctacttggcctctgcgaggc
 Y  W  G  D  V  V  D  G  I  F  S  W  E  S  T  W  P  L  R  G agcactcaaacatcttactggaagaacgagacgtggatttcgtccacgtgcagcttccac
 S  T  Q  T  S  Y  W  K  N  E  T  W  I  S  S  T  C  S  F  H cgactaacattcggctttctaggcttgagcatgctgcaatacgagaactcggtggggttt
 R  L  T  F  G  F  L  G  L  S  M  L  Q  Y  E  N  S  V  G  F ttgctccgacttgagcctcaagcgctgaccacgtggtcgatatag
 L  L  R  L  E  P  Q  A  L  T  T  W  S  I  -
```

SEQ ID NO: 231
LENGTH: 254
TYPE: PRT
ORGANISM: M. phaseolina
MALNRGFMAALASFLVLTTADLGAAKAVTRGVFAKYMVGNVYEDHAHQDIKDASAMGLDGFALNIGDPSQDFV

RQTLNYMFDYARDNYPDFKLFISMDLWAAGSAKKGLNDFVGILRDYMGHGAYYKRPNGYPFISTFADGGLENT

TWMDWRNKWANEIYFVPDFGGSKAYCLSDPGWWEYWGDVVDGIFSWESTWPLRGSTQTSYWKNETWISSTCSF

HRLTFGFLGLSMLQYENSVGFLLRLEPQALTTWSI*

SEQ ID NO: 232
LENGTH: 1839 (including 150 bp 5' UTR and 150 bp 3' UTR)
TYPE: DNA
ORGANISM: M. phaseolina
AAGGCCAGGGCACCCGCTCGCTGCAGCTCCCAACGCGGGAACCCGCGCCGCGCCCAGTCGGCTTGTCGGAAGT

ACGAGCGTCTTCAACGCGACTTGTCTCCAGAATAAATACCACTCCACCGTCGCCCGTCGCAATGGCCCCCATC

AACCATGGACCGCCTGGAGAGTTTCTGGAAGAAGAGCAAGCGCGAGGTGCAGGGCGTGCTGGAGGACGTCGGT

CTGCGCGACTCGCGCCCTGACGACTCCCACGCCCAGCCTCCACCACCACCTTTCGAGTCGCACCCAAGCCTCC

AGTTCCACGATAGGCGTCCCCAGCTCGACCACTGCCACCATGACTGCCGCCGCCGCCGCAAGGGCATCTTCTG

CCACTACATGGTATTCTTTGGCCCCACTCCCGTGCAATCAGCGAGTGGCTAATCGGCCCCGCAGGTGGGCAGC

ATGGGCAGCATTGAGCAGGCCCACACTGACGTGCGAGAGGCCAAAGCCGTCGGCTTCGATGGCTTCGTGTTGA

ACGTGCAGAATGTAAAGGACGATTGGTCGTTGACTGCCCTCTCGTGGGTCTTCTCCGCCGCCGAGGCCGCCGA

CTTCAAGCTCTTTTTCTCCTTCGACATGGACGTCCTCGCCGACCCCGTCGATTTCCTGCCGCTCTTCGTGCAC

TATCAAGCCCATCCGGCCTACTATCGCTACCAGGGGCTCCCGTTCGTCAGCACCTTCCAAGGAGGCCGCAAGA

GCTTCGACCTCCCGCATCCCAATGAGGGCTGGACGCTTAAGTTCCGAGCTCAGCTGCAGGACCGTTACGGAAT

CATTCCCTTCTTCGTGCCCGATTTCGACGACCATGGTGGAGCCGCATATGACGACCATTTCTTCAGCCGTTAC

CCCGTCGTGGACGGTGTTTTCAGCTGGGAGACAGCGTGGCCGTTCAAGGATGACGGCGTCAGTGACGTAAGCT

CGGCTGCTGATGAAATTGGCATGAACTGCGCCCATAATGCCAGCAAGGTGTACATGATGCCTATGTCCACACT

CCAGTTCAAACGCATAGACGGCAGCGGCAATTGGTATCGACGTGGCGAGCTCAACCTCGCCCAGAGAATGGCC

CAGGTGCTCGCGCTTTCTCCAGATTTTGTGCAGATAATCTCGTGGAACGACGCAGGCGAGAGTCACTATATTG

GAAACGTCTGGCCTGAGGGTATTGCCAGTTGCCCGGATATTGGCCTTTACACCGATGGCTATGATCATAAGGC

CTGGCTGCATATTATCGCTCCCTTCATCGCCGCCTACAAAGCCGGGGCCACGGATCCCTCCCAGATCCTGCCC

TTTGGTGATTTTGCAGGTGCATTCTGGTACCGTGACCGCCTGGCTGATACTCATTGCCCTGGTGATAGCATGG

GCAAACCCAGTGGCTGTGAGAACGCAGAGGATGCTATCAATCTTGCCATTCTCCTTCCTGCGGACACCCAGGG

CGTCGGTATCAACGTCTGGAGCGGCGGTGAGCTCCTCGCCTCTATACCTGGGCAGCCAGGCCTAAATGCCCAC

TGCGTTAAAGGAGCGAAGACGGGTCCGCAAAGGGTGGAGCTTATCAAGGATGGCCATATTCCAATGGGCGCCG

GAGACGGCCCTGTCAATATCACCGCAGACGCAGACGAAGGCAAGACCTACAACTTCAATTATCACGTGGTACA

TATCTCTTGAGCAAACTTTACGATCTTTCCTTAGCTTAAAAAAACCTAAAATATCTGTATTCAAACAATCTGG

-continued

AGAACCAATGAAAGGCATGAATAGAGCTCTGGCTAAGGAGCGCGCATCAGCGAGCACATGTAACTATACAGTC

AAGCTGAGTTGGTC

```
SEQ ID NO: 233
LENGTH: 1485
TYPE: DNA
ORGANISM: M. phaseolina
FEATURE NAME/KEY: CDS
LOCATION: (1)...(1485)
atggaccgcctggagagtttctggaagaagagcaagcgcgaggtgcagggcgtgctggag
 M  D  R  L  E  S  F  W  K  K  S  K  R  E  V  Q  G  V  L  E gacgtcggtctgcgcgactcgcgccctgacgactccacgcccagcctccaccaccacct
 D  V  G  L  R  D  S  R  P  D  D  S  H  A  Q  P  P  P  P  P ttcgagtcgcacccaagcctccagttccacgataggcgtccccagctcgaccactgccac
 F  E  S  H  P  S  L  Q  F  H  D  R  R  P  Q  L  D  H  C  H catgactgccgccgccgccgcaagggcatcttctgccactacatggtgggcagcatgggc
 H  D  C  R  R  R  R  K  G  I  F  C  H  Y  M  V  G  S  M  G agcattgagcaggcccacactgacgtgcgagaggccaaagccgtcggcttcgatgccttc
 S  I  E  Q  A  H  T  D  V  R  E  A  K  A  V  G  F  D  A  F gtgttgaacgtgcagaatgtaaaggacgattggtcgttgactgccctctcgtgggtcttc
 V  L  N  V  Q  N  V  K  D  D  W  S  L  T  A  L  S  W  V  F tccgccgccgaggccgccgacttcaagctcttttcctcttcgacatggacgtcctcgcc
 S  A  A  E  A  A  D  F  K  L  F  F  S  F  D  M  D  V  L  A gaccccgtcgatttcctgccgctcttcgtgcactatcaagcccatccggcctactatcgc
 D  P  V  D  F  L  P  L  F  V  H  Y  Q  A  H  P  A  Y  Y  R taccaggggctcccgttcgtcagcaccttccaaggaggccgcaagagcttcgacctcccg
 Y  Q  G  L  P  F  V  S  T  F  Q  G  G  R  K  S  F  D  L  P catcccaatgagggctggacgcttaagttccgagctcagctgcaggaccgttacggaatc
 H  P  N  E  G  W  T  L  K  F  R  A  Q  L  Q  D  R  Y  G  I attcccttcttcgtgcccgatttcgacgaccatggtggagccgcatatgacgaccatttc
 I  P  F  F  V  P  D  F  D  D  H  G  G  A  A  Y  D  D  H  F ttcagccgttaccccgtcgtggacggtgttttcagctgggagacagcgtggccgttcaag
 F  S  R  Y  P  V  V  D  G  V  F  S  W  E  T  A  W  P  F  K gatgacggcgtcagtgacgtaagctcggctgctgatgaaattggcatgaactgcgcccat
 D  D  G  V  S  D  V  S  S  A  A  D  E  I  G  M  N  C  A  H aatgccagcaaggtgtacatgatgcctatgtccacactccagttcaaacgcatagacggc
 N  A  S  K  V  Y  M  M  P  M  S  T  L  Q  F  K  R  I  D  G agcggcaattggtatcgacgtggcgagctcaacctcgcccagagaatggcccaggtgctc
 S  G  N  W  Y  R  R  G  E  L  N  L  A  Q  R  M  A  Q  V  L gcgctttctccagattttgtgcagataatctcgtggaacgacgcaggcgagagtcactat
 A  L  S  P  D  F  V  Q  I  I  S  W  N  D  A  G  E  S  H  Y attggaaacgtctggcctgagggtattgccagttgcccggatattggcctttacaccgat
 I  G  N  V  W  P  E  G  I  A  S  C  P  D  I  G  L  Y  T  D ggctatgatcataaggcctggctgcatattatcgctcccttcatcgccgcctacaaagcc
 G  Y  D  H  K  A  W  L  H  I  I  A  P  F  I  A  A  Y  K  A ggggccacggatccctcccagatcctgccctttggtgattttgcaggtgcattctggtac
 G  A  T  D  P  S  Q  I  L  P  F  G  D  F  A  G  A  F  W  Y cgtgaccgcctggctgatactcattgccctggtgatagcatgggcaaacccagtggctgt
 R  D  R  L  A  D  T  H  C  P  G  D  S  M  G  K  P  S  G  C gagaacgcagaggatgctatcaatcttgccattctccttcctgcggacacccagggcgtc
 E  N  A  E  D  A  I  N  L  A  I  L  L  P  A  D  T  Q  G  V ggtatcaacgtctggagcggcggtgagctcctcgcctctatacctgggcagccaggccta
 G  I  N  V  W  S  G  G  E  L  L  A  S  I  P  G  Q  P  G  L aatgcccactgcgttaaaggagcgaagacgggtccgcaaagggtggagcttatcaaggat
 N  A  H  C  V  K  G  A  K  T  G  P  Q  R  V  E  L  I  K  D
```

```
ggccatattccaatgggcgccggagacggccctgtcaatatcaccgcagacgcagacgaa
 G  H  I  P  M  G  A  G  D  G  P  V  N  I  T  A  D  A  D  E ggcaagacctacaacttcaattatcacgtggtacatatctcttga
 G  K  T  Y  N  F  N  Y  H  V  V  H  I  S  -
```

SEQ ID NO: 234
LENGTH: 494
TYPE: PRT
ORGANISM: M. phaseolina
MDRLESFWKKSKREVQGVLEDVGLRDSRPDDSHAQPPPPPFESHPSLQFHDRRPQLDHCHHDCRRRRKGIFCH

YMVGSMGSIEQAHTDVREAKAVGFDAFVLNVQNVKDDWSLTALSWVFSAAEAADFKLFFSFDMDVLADPVDFL

PLFVHYQAHPAYYRYQGLPFVSTFQGGRKSFDLPHPNEGWTLKFRAQLQDRYGIIPFFVPDFDDHGGAAYDDH

FFSRYPVVDGVFSWETAWPFKDDGVSDVSSAADEIGMNCAHNASKVYMMPMSTLQFKRIDGSGNWYRRGELNL

AQRMAQVLALSPDFVQIISWNDAGESHYIGNVWPEGIASCPDIGLYTDGYDHKAWLHIIAPFIAAYKAGATDP

SQILPFGDFAGAFWYRDRLADTHCPGDSMGKPSGCENAEDAINLAILLPADTQGVGINVWSGGELLASIPGQP

GLNAHCVKGAKTGPQRVELIKDGHIPMGAGDGPVNITADADEGKTYNFNYHVVHIS*

SEQ ID NO: 235
LENGTH: 1972 (including 150 bp 5' UTR and 150 bp 3' UTR)
TYPE: DNA
ORGANISM: M. phaseolina
CATGGGGGCCGCTTCCGTGATTTGTTGGAAATCTGGGTGTCGCAGTGGCTGGACAGGAGATGCGGTGGGACGC

TTTTTCTTTGTTCTTTTTTAAACTTCGCCCTGTTCTGCTTTCTTTCTTTTATCCGACACCTTAAATTCACTTA

CATTATGCGGTTATCCCGGCGCTTAGCCGCCGCTACGGCAGGCCTTCTCTATGCGGACATAGTGGCCGCTGTA

GCTTCCAAAGCCGTCTTCGCGCATTACATGGTTGGTTCGCCTCCAGACCGCTTTCCAGCGATAAGTGAGCTTA

CGCATGCAAGGTGGGGACCGTCTTCGAGGACCATGTCAAGCAAGATGTCGACGATGCAGCGGCCATGGGTCTC

GATGGCTTCGCGCTCAATGTCGGGGACCCGACTGGGTCTGAAACTCGAACGCTGCTGGGCAACATCATGGACT

ATGCTGCCAGCAGCCACTCGGATTTCAAGTTCTTCATCAGCATGGACTTGTTCTCGCCCAAGAATCTGTCCGA

TTTCGATCAGATACTGACGGACTTTCTGGGACACGAAGCATACTACAAGGGCTCCGATGGATATCCCTTCGTC

AGCACTTATGGAAGCGGCGAATTCGATGAGAACGTCTGGAGCGACTGGCGGGACAAATGGGCAGATAAAATAT

ATTTCGTGCCTGACTTTGCCGACGCCATGGCTCTGGAGGGATCCGATGGCTGGTGGGACAAGTGGGGAGCGTT

GATTGCTGGCCTATTCAGCTGGGAGAGCACGTGGCCGGCGAGAGGACAGGCGGCGACATTCCAGGCTGTTGAA

GTGGATAAGAAGCCTGAGTGGACTAAGCAAAGAAACAAGGCATACATGATTGGTAGGCACCGGCCACCTCTCC

TGATTCAGAGACCAATTCCATACTTACCATCTGGGTTGCAGGCTTGAGTATGCTACAATACAAGAATTCCTAC

GGCGCGAACATCTACCGCGCCGGCGAAGAGAACCTCCCGCTGCGGATGAGCAACATCCTCGACATGGACGACC

GGCCCGACTTCACACAAATCCTCACATGGGTACGTCACATCCCCAACTGCCTCTCAGCCAAATCCACTGACTT

TTTCCCCCAGAACGACGGGCCCGAAAGCCACTACATCGGCAACATTTGGCCTGAGCAAGACAACACTACCGAA

ATGCGGCGGTACGCCAACGACGACGCGCCCCACAAAGCCATCCAGCCCATCCTCAGCTCCTTCATCACCGCCT

TCAAATCCGGCGCCTCTTCGCAGGAAATGGCGCCGCCCGGCAACGCCAGGGCCGCCGGCTCGCTATGGTTCAA

GCCTATCCTCGCCAACACATCCTGCCCGCAGGACAACGACCTGCACAGCGGCAAGCCCGACGGCTACGAGGTT

GCCGTCGACGTCTCTTCCTGGGCCGTCGTCGTCAGCGATAATGGCGGGAACATGACGCTGCACGGATTCAGCG

ACGGTGAGGAGATCGGATCCGCAGACCTCGTCGCTGGATTGAACTTTGGGAACTTTAGCGCTATGCGGGAGGG

TCCACAGTGCATGGAGGTGCGGAGCGAGCACGGTGGATTGGTGCGGTGGCAAAGGGCGGGAGGAATGTGACG

TCGGACTGCCCCGACGGGATTTACAACCTGAATCCGCAGATCCTGCAGCTGGTCAGTGATGATTCGGTGGGCG

GGTGCGCGAGCTCGAAGAGCTCTTCGTCAGATGATGATGATGATGACTCGGGAAGTGTGCTGGCCGTTATGCT

GGACAGATACGTCTTCTGGACTGCGCTTCTTGCATCCTTGGCCTCTGTTACAGGTGTCGTTGGACTCTGAGGA

AAATGAAGGAATGAAATGTATTAATACGGCGTTTTTGACACACCCTGAGGAATAGAGGGATTAGAGACACATC

```
GTGGACTCGTTCTCGCGGCATGCCACATGGAAAACAGCACCATCATGATATTTTAGTATTTCTCTTTCACGTC
```

A

```
SEQ ID NO: 236
LENGTH: 1503
TYPE: DNA
ORGANISM: M. phaseolina
FEATURE NAME/KEY: CDS
LOCATION: (1)...(1503)
atgcggttatcccggcgcttagccgccgctacggcaggccttctctatgcggacatagtg
 M   R   L   S   R   R   L   A   A   A   T   A   G   L   L   Y   A   D   I   V gccgctgtagcttccaaagccgtcttcgcgcattacatggtggggaccgtcttcgaggac
 A   A   V   S   K   A   V   F   A   H   Y   M   V   G   T   V   F   E   D catgtcaagcaagatgtcgacgatgcagcggccatgggtctcgatggcttcgcgctcaat
 H   V   K   Q   D   V   D   D   A   A   A   M   G   L   D   G   F   A   L   N gtcggggacccgactgggtctgaaactcgaacgctgctgggcaacatcatggactatgct
 V   G   D   P   T   G   S   E   T   R   T   L   L   G   N   I   M   D   Y   A gccagcagccactcggatttcaagttcttcatcagcatggacttgttctcgcccaagaat
 A   S   S   H   S   D   F   K   F   F   I   S   M   D   L   F   S   P   K   N ctgtccgatttcgatcagatactgacggactttctgggacacgaagcatactacaagggc
 L   S   D   F   D   Q   I   L   T   D   F   L   G   H   E   A   Y   Y   K   G tccgatggatatcccttcgtcagcacttatggaagcggcgaattcgatgagaacgtctgg
 S   D   G   Y   P   F   V   S   T   Y   G   S   G   E   F   D   E   N   V   W agcgactggcgggacaaatgggcagataaaatatatttcgtgcctgactttgccgacgcc
 S   D   W   R   D   K   W   A   D   K   I   Y   F   V   P   D   F   A   D   A atggctctggagggatccgatggctggtgggacaagtggggagcgttgattgctggccta
 M   A   L   E   G   S   D   G   W   W   D   K   W   G   A   L   I   A   G   L ttcagctgggagagcacgtggccggcgagaggacaggcggcgacattccaggctgttgaa
 F   S   W   E   S   T   W   P   A   R   G   Q   A   A   T   F   Q   A   V   E gtggataagaagcctgagtggactaagcaaagaaacaaggcatacatgattggcttgagt
 V   D   K   K   P   E   W   T   K   Q   R   N   K   A   Y   M   I   G   L   S atgctacaatacaagaattcctacggcgcgaacatctaccgcgccggcgaagagaacctc
 M   L   Q   Y   K   N   S   Y   G   A   N   I   Y   R   A   G   E   E   N   L ccgctgcggatgagcaacatcctcgacatggacgaccggcccgacttcacacaaatcctc
 P   L   R   M   S   N   I   L   D   M   D   D   R   P   D   F   T   Q   I   L acatggaacgacgggcccgaaagccactacatcggcaacattggcctgagcaagacaac
 T   W   N   D   G   P   E   S   H   Y   I   G   N   I   W   P   E   Q   D   N actaccgaaatgcggcggtacgccaacgacgacgcgccccacaaagccatccagcccatc
 T   T   E   M   R   R   Y   A   N   D   D   A   P   H   K   A   I   Q   P   I ctcagctccttcatcaccgccttcaaatccggcgcctcttcgcaggaaatggcgccgccc
 L   S   S   F   I   T   A   F   K   S   G   A   S   S   Q   E   M   A   P   P ggcaacgccagggccgccggctcgctatggttcaagcctatcctcgccaacacatcctgc
 G   N   A   R   A   A   G   S   L   W   F   K   P   I   L   A   N   T   S   C ccgcaggacaacgacctgcacagcggcaagcccgacggctacgaggttgccgtcgacgtc
 P   Q   D   N   D   L   H   S   G   K   P   D   G   Y   E   V   A   V   D   V tcttcctgggccgtcgtcgtcagcgataatggcgggaacatgacgctgcacggattcagc
 S   S   W   A   V   V   V   S   D   N   G   G   N   M   T   L   H   G   F   S gacggtgaggagatcggatccgcagacctcgtcgctggattgaactttgggaactttagc
 D   G   E   E   I   G   S   A   D   L   V   A   G   L   N   F   G   N   F   S gctatgcgggagggtccacagtgcatggaggtgcggagcgagcacggtggattggttgcg
 A   M   R   E   G   P   Q   C   M   E   V   R   S   E   H   G   G   L   V   A gtggcaaagggcgggaggaatgtgacgtcggactgccccgacgggatttacaacctgaat
 V   A   K   G   G   R   N   V   T   S   D   C   P   D   G   I   Y   N   L   N ccgcagatcctgcagctggtcagtgatgattcggtgggcgggtgcgcgagctcgaagagc
 P   Q   I   L   Q   L   V   S   D   D   S   V   G   G   C   A   S   S   K   S
```

```
                          -continued
tcttcgtcagatgatgatgatgatgactcgggaagtgtgctggccgttatgctggacaga
 S   S   S   D   D   D   D   D   D   S   G   S   V   L   A   V   M   L   D   R tacgtcttctggactgcgcttcttgcatccttggcctctgttacaggtgtcgttggactc
 Y   V   F   W   T   A   L   L   A   S   L   A   S   V   T   G   V   V   G   L tga
 -
```

SEQ ID NO: 237
LENGTH: 500
TYPE: PRT
ORGANISM: M. phaseolina

MRLSRRLAAATAGLLYADIVAAVASKAVFAHYMVGTVFEDHVKQDVDDAAAMGLDGFALNVGDPTGSETRTLL

GNIMDYAASSHSDFKFFISMDLFSPKNLSDFDQILTDFLGHEAYYKGSDGYPFVSTYGSGEFDENVWSDWRDK

WADKIYFVPDFADAMALEGSDGWWDKWGALIAGLFSWESTWPARGQAATFQAVEVDKKPEWTKQRNKAYMIGL

SMLQYKNSYGANIYRAGEENLPLRMSNILDMDDRPDFTQILTWNDGPESHYIGNIWPEQDNTTEMRRYANDDA

PHKAIQPILSSFITAFKSGASSQEMAPPGNARAAGSLWFKPILANTSCPQDNDLHSGKPDGYEVAVDVSSWAV

VVSDNGGNMTLHGFSDEEIGSADLVAGLNFGNFSAMREGPQCMEVRSEHGGLVAVAKGGRNVTSDCPDGIYN

LNPQILQLVSDDSVGGCASSKSSSSDDDDDDSGSVLAVMLDRYVFWTALLASLASVTGVVGL*

SEQ ID NO: 238
LENGTH: 1110 (including 150 bp 5' UTR and 150 bp 3' UTR)
TYPE: DNA
ORGANISM: M. phaseolina

CCGGCCACCTCTCCTGATTCAGAGACCAATTCCATACTTACCATCTGGGTTGCAGGCTTGAGTATGCTACAAT

ACAAGAATTCCTACGGCGCGAACATCTACCGCGCCGGCGAAGAGAACCTCCCGCTGCGGATGAGCAACATCCT

CGACATGGACGACCGGCCCGACTTCACACAAATCCTCACATGGGTACGTCACATCCCCAACTGCCTCTCAGCC

AAATCCACTGACTTTTTCCCCCAGAACGACGGGCCCGAAAGCCACTACATCGGCAACATTTGGCCTGAGCAAG

ACAACACTACCGAAATGCGGCGGTACGCCAACGACGACGCGCCCCACAAAGCCATCCAGCCCATCCTCAGCTC

CTTCATCACCGCCTTCAAATCCGGCGCCTCTTCGCAGGAAATGGCGCCGCCCGGCAACGCCAGGGCCGCCGGC

TCGCTATGGTTCAAGCCTATCCTCGCCAACACATCCTGCCCGCAGGACAACGACCTGCACAGCGGCAAGCCCG

ACGGCTACGAGGTTGCCGTCGACGTCTCTTCCTGGGCCGTCGTCGTCAGCGATAATGGCGGGAACATGACGCT

GCACGGATTCAGCGACGGTGAGGAGATCGGATCCGCAGACCTCGTCGCTGGATTGAACTTTGGGAACTTTAGC

GCTATGCGGGAGGGTCCACAGTGCATGGAGGTGCGGAGCGAGCACGGTGGATTGGTTGCGGTGGCAAAGGGCG

GGAGGAATGTGACGTCGGACTGCCCCGACGGGATTTACAACCTGAATCCGCAGATCCTGCAGCTGGTCAGTGA

TGATTCGGTGGGCGGGTGCGCGAGCTCGAAGAGCTCTTCGTCAGATGATGATGATGATGACTCGGGAAGTGTG

CTGGCCGTTATGCTGGACAGATACGTCTTCTGGACTGCGCTTCTTGCATCCTTGGCCTCTGTTACAGGTGTCG

TTGGACTCTGAGGAAAATGAAGGAATGAAATGTATTAATACGGCGTTTTTGACACACCCTGAGGAATAGAGGG

ATTAGAGACACATCGTGGACTCGTTCTCGCGGCATGCCACATGGAAAACAGCACCATCATGATATTTTAGTAT

TTCTCTTTCACGTCA

SEQ ID NO: 239
LENGTH: 810
TYPE: DNA
ORGANISM: M. phaseolina
FEATURE NAME/KEY: CDS
LOCATION: (1)...(810)

```
atggacgaccggcccgacttcacacaaatcctcacatgggtacgtcacatccccaactgc
 M   D   D   R   P   D   F   T   Q   I   L   T   W   V   R   H   I   P   N   C ctctcagccaaatccactgactttttcccccagaacgacgggcccgaaagccactacatc
 L   S   A   K   S   T   D   F   F   P   Q   N   D   G   P   E   S   H   Y   I ggcaacatttggcctgagcaagacaacactaccgaaatgcggcggtacgccaacgacgac
 G   N   I   W   P   E   Q   D   N   T   T   E   M   R   R   Y   A   N   D   D gcgccccacaaagccatccagcccatcctcagctccttcatcaccgccttcaaatccggc
 A   P   H   K   A   I   Q   P   I   L   S   S   F   I   T   A   F   K   S   G
```

-continued

```
gcctcttcgcaggaaatggcgccgcccggcaacgccagggccgccggctcgctatggttc
 A  S  S  Q  E  M  A  P  P  G  N  A  R  A  A  G  S  L  W  F aagcctatcctcgccaacacatcctgcccgcaggacaacgacctgcacagcggcaagccc
 K  P  I  L  A  N  T  S  C  P  Q  D  N  D  L  H  S  G  K  P gacggctacgaggttgccgtcgacgtctcttcctgggccgtcgtcgtcagcgataatggc
 D  G  Y  E  V  A  V  D  V  S  S  W  A  V  V  V  S  D  N  G gggaacatgacgctgcacggattcagcgacggtgaggagatcggatccgcagacctcgtc
 G  N  M  T  L  H  G  F  S  D  G  E  E  I  G  S  A  D  L  V gctggattgaactttgggaactttagcgctatgcgggagggtccacagtgcatggaggtg
 A  G  L  N  F  G  N  F  S  A  M  R  E  G  P  Q  C  M  E  V cggagcgagcacggtggattggttgcggtggcaaagggcggaggaatgtgacgtcggac
 R  S  E  H  G  G  L  V  A  V  A  K  G  G  R  N  V  T  S  D tgccccgacgggatttacaacctgaatccgcagatcctgcagctggtcagtgatgattcg
 C  P  D  G  I  Y  N  L  N  P  Q  I  L  Q  L  V  S  D  D  S gtgggcgggtgcgcgagctcgaagagctcttcgtcagatgatgatgatgatgactcggga
 V  G  G  C  A  S  S  K  S  S  S  S  D  D  D  D  D  D  S  G agtgtgctggccgttatgctggacagatacgtcttctggactgcgcttcttgcatccttg
 S  V  L  A  V  M  L  D  R  Y  V  F  W  T  A  L  L  A  S  L gcctctgttacaggtgtcgttggactctga
 A  S  V  T  G  V  V  G  L  -

SEQ ID NO: 240
LENGTH: 269
TYPE: PRT
ORGANISM: M. phaseolina
MDDRPDFTQILTWVRHIPNCLSAKSTDFFPQNDGPESHYIGNIWPEQDNTTEMRRYANDDAPHKAIQPILSSF

ITAFKSGASSQEMAPPGNARAAGSLWFKPILANTSCPQDNDLHSGKPDGYEVAVDVSSWAVVVSDNGGNMTLH

GFSDGEEIGSADLVAGLNFGNFSAMREGPQCMEVRSEHGGLVAVAKGGRNVTSDCPDGIYNLNPQILQLVSDD

SVGGCASSKSSSSDDDDDDSGSVLAVMLDRYVFWTALLASLASVTGVVGL*

SEQ ID NO: 241
LENGTH: 1083 (including 150 bp 5' UTR and 150 bp 3' UTR)
TYPE: DNA
ORGANISM: M. phaseolina
CTTTGAGAGGCACAAATCTCGGAAGCTGGTAGAGTTCTCAGGTTACAGCTCCTTCAATAATGTTTCCGCTCGA

AGTGATGAGTGTATATATATTCTCCATACGCTCGCTTTCTTGTCCAAAGCATCACTTCCTCCACCTCCATCTT

TGCGATGCATCCTTTGTCCTTCCACTCCTTATTACCATTCGCGATCAGTCTGGTTGCCTTCTTCTCTCGGAAT

GCCAGCGCTAAGGCTGTCTTTGCCCACTACATGGTATGCTATCGACCAGCCTTAACCTTGCTATACAAGTCTC

GTTCTTGTTGCAGAGCAAAGGATGATCGGAGACTTACCCTTTCACAGGTCGGGCATGCCGATGAGGATCACAT

ACATACAGATATCGAGGATGCCGTGACTATGGGCCTCGATGGCTTCTCGCTCAACATTGGCGACCCAAGACAA

TCTTTTGTCCGCGAATCTCTGAACGCCATGTTCGACTACACCCGGGACAATCATCCGAACTTTAAGCTCTTTA

TCAGCATGGATCTTTGGGCTGCTGGCGACACCAAACCAAAACAGTCAGCGACAGACTTTCTCAGTCTCGTGAA

AGACTACAAGGGCCATGGTGCATACCAACTTGCGGGCCCCGACAACCTTCCGTTCGTCACAACATTTGCTGAT

GGCGGCCTCAACAACGTAACATGGAACGAGTGGCGCGACGAACTGGATAACAAAATCTTCTTCATTCCTGACT

TTGATGGAACCGAGGGATATTACGACTCTGACCCAGGATGGTGGGCCCATTGGCAAAATACAGTGGATGGTCT

TGCTAGCTGGGAATCTGCTTGGCCGTTTCGCGCTGGATATGGTGGCGAATACCCCGGTGACGTCAGTCCCGAT

GAGACGGTCTTGCAGGGCGCGACAAATCACTCGAAGCCATATATGATTCGTATGTAACAACTCCTTGACGAGT

GATATTAGGAACTAACAGGCATCAAACAGCTTTAAGCCCTTTACAGTATAAGAATGCGGTAAGCTCTATTACC

GCTCAACCAGGTATATTATGCTAACCATCGCAGTATCACACGAACATATACCGAGCCGGTG
```

-continued

SEQ ID NO: 242
LENGTH: 783
TYPE: DNA
ORGANISM: M. phaseolina
FEATURE NAME/KEY: CDS
LOCATION: (1)...(783)
```
atgcatcctttgtccttccactccttattaccattcgcgatcagtctggttgccttcttc
 M   H   P   L   S   F   H   S   L   L   P   F   A   I   S   L   V   A   F   F tctcggaatgccagcgctaaggctgtctttgcccactacatggtatgctatcgaccagcc
 S   R   N   A   S   A   K   A   V   F   A   H   Y   M   V   C   Y   R   P   A ttaaccttgctatacaagtctcgttcttgttgcagagcaaaggatgatcggagacttacc
 L   T   L   L   Y   K   S   R   S   C   C   R   A   K   D   D   R   R   L   T ctttcacaggtcgggcatgccgatgaggatcacatacatacagatatcgaggatgccgtg
 L   S   Q   V   G   H   A   D   E   D   H   I   H   T   D   I   E   D   A   V actatgggcctcgatggcttctcgctcaacattggcgacccaagacaatctttgtccgc
 T   M   G   L   D   G   F   S   L   N   I   G   D   P   R   Q   S   F   V   R gaatctctgaacgccatgttcgactacacccgggacaatcatccgaactttaagctcttt
 E   S   L   N   A   M   F   D   Y   T   R   D   N   H   P   N   F   K   L   F atcagcatggatctttgggctgctggcgacaccaaaccaaaacagtcagcgacagacttt
 I   S   M   D   L   W   A   A   G   D   T   K   P   K   Q   S   A   T   D   F ctcagtctcgtgaaagactacaagggccatggtgcataccaacttgcgggccccgacaac
 L   S   L   V   K   D   Y   K   G   H   G   A   Y   Q   L   A   G   P   D   N cttccgttcgtcacaacatttgctgatggcggcctcaacaacgtaacatggaacgagtgg
 L   P   F   V   T   T   F   A   D   G   G   L   N   N   V   T   W   N   E   W cgcgacgaactggataacaaaatcttcttcattcctgactttgatggaaccgagggatat
 R   D   E   L   D   N   K   I   F   F   I   P   D   F   D   G   T   E   G   Y tacgactctgacccaggatggtgggcccattggcaaaatacagtggatggtcttgctagc
 Y   D   S   D   P   G   W   W   A   H   W   Q   N   T   V   D   G   L   A   S tgggaatctgcttggccgtttcgcgctggatatggtggcgaatacccggtgacgtcagt
 W   E   S   A   W   P   F   R   A   G   Y   G   G   E   Y   P   G   D   V   S cccgatgagacggtcttgcagggcgcgacaaatcactcgaagccatatatgattcgtatg
 P   D   E   T   V   L   Q   G   A   T   N   H   S   K   P   Y   M   I   R   M
taa
 -
```

SEQ ID NO: 243
LENGTH: 260
TYPE: PRT
ORGANISM: M. phaseolina
MHPLSFHSLLPFAISLVAFFSRNASAKAVFAHYMVCYRPALTLLYKSRSCCRAKDDRRLTLSQVGHADEDHIH

TDIEDAVTMGLDGFSLNIGDPRQSFVRESLNAMFDYTRDNHPNFKLFISMDLWAAGDTKPKQSATDFLSLVKD

YKGHGAYQLAGPDNLPFVTTFADGGLNNVTWNEWRDELDNKIFFIPDFDGTEGYYDSDPGWWAHWQNTVDGLA

SWESAWPFRAGYGGEYPGDVSPDETVLQGATNHSKPYMIRM*

SEQ ID NO: 244
LENGTH: 1551 (including 150 bp 5' UTR and 150 bp 3' UTR)
TYPE: DNA
ORGANISM: M. phaseolina
GAGCAAGTGTTCTCCCAGAAGTTAGTATTCGCACACTACATGGTTCGTCCTCACCGATGCATGGCGTGATACC

CGCTGCTCACGCTCAAGGATTAGGTCGGAACAGTCACGGCAGACCATGCCCACCAAGACATCGACAACGCCGC

AGCAATGGGCCTCGACGGCTTCGCGCTCAACATCGGCGACCCGACCCAGCCCTTTGTCCGGCGGACGCTGGAC

TCCATGTTCAACTACACGCGCGACCGGCACCCCAAATTCAAGCACTTCTTCAGCCTCGACCTCTGGGCGGCGG

GCGGCGCGGGAAAGAGGCTCGAGGACTACGACGGCTTGCTGCGCGACTTCATGGGCCACGCGGCGTACCAGAA

AGGGGCCAACGGCTTCCCCTTCGTCAGCACCTTTGGCGACGGCGGCACCACCAAGGACGTCTGGCTCGCCTGG

CGCGAGAAGTGGGCCAACAAGGTCTACCTCGTCCCCGGACTTCGACCAGACCCAGGGCTACTACGAGGCCGCGC

CCGGCTGGTGGAGCCACTGGGGCGACGTCGTCGACGGGCTCTTCAGCTGGGAGTCGACCTGGCCGTGGGCGGG

CGCGCGCAGCACGGCCGACGCCTCGCTCGACCAGGCCGTCGCGGCGGGCGCGCGGCAGCGCAAGAAGGCGTAC

```
ATGATGGGGCTCAGCCTGCTGCAGTACAAGAACGCGTACGGGGCGCGGGTCTGGCGCGCGGGCGAGGACCTGC

TCCCGCAGCGCATGACGAGCATCCTGGCCATGTCGCCGCCGCCCGACTACGTCGAGCTCCTGACGTGGAACGA

CGGGCCCGAGAGCCACTACGTCGGCAGCCTGTGGCCGGAGCAGAACGGCGACCGCGAGCCCGCCGCCTACGCC

AACGGCGCCGCGCCCCACACCGCCCTGCAGCCGCTGCTGGCCTCCTTCATCGCCGCGTACAAGGCCGGCCGCG

GGCCCGCCGCCATGCGCCCGCCCCAGCTGACCCCCGCCCGCCCCGTCGTCGGCGCCATCTGGTACAAGCCCGT

CAGCTCGCAGACGCTGTGCCCCGGCGCGGGTCCGTCCGCGCAGGAGCCGCTGGGCTATGGCGCGGCGAGGGAC

GTTGTCGCGTACGGCGTCGTCGTCGGGGCTGGCAGCGATGTCGCCGGCTGGAAGCTCAGGATGTGGAGCGGGG

GCGTGCAGGTCGGGGCCGCGGTGCCGCTCGTGCCGGGCCTGAACAGCGGCGTCTTCGGTGCGCTGAATCCGGG

CGGCCAGAGGCTGGAGGTGCTGAATAAGGAGAACAGGGTTGTCATGAGGGCTGCTGGCGGCAGGTGCGTGACA

AAGACTTGTCCGGACGGCATCTACAACCTGAATCCTCAGGTCGTGGGGCTGCAGATGGGCGCGGATTATCCTG

CATGTCGGCCATGAATGGGGTGGGGTGGGTGCATGAGGATCAGTAACTGAGCTTCGTGAGGCAGTGTGGCAGG

TAGATGGCCTTGATCTGACTCTCACGACCTGTTATGGAAGAGTGCCGATTGGCCAGGGGGCGGAAGCGAAAGT

TTTTCCTGCCATTTCAAC

SEQ ID NO: 245
LENGTH: 1251
TYPE: DNA
ORGANISM: M. phaseolina
FEATURE NAME/KEY: CDS
LOCATION: (1)...(1251)
atgggcctcgacggcttcgcgctcaacatcggcgacccgacccagccctttgtccggcgg
 M   G   L   D   G   F   A   L   N   I   G   D   P   T   Q   P   F   V   R   R acgctggactccatgttcaactacacgcgcgaccggcaccccaaattcaagcacttcttc
 T   L   D   S   M   F   N   Y   T   R   D   R   H   P   K   F   K   H   F   F agcctcgacctctgggcgcgggcggcgcgggaaagaggctcgaggactacgacggcttg
 S   L   D   L   W   A   A   G   G   A   G   K   R   L   E   D   Y   D   G   L ctgcgcgacttcatgggccacgcggcgtaccagaaaggggccaacggcttccccttcgtc
 L   R   D   F   M   G   H   A   A   Y   Q   K   G   A   N   G   F   P   F   V agcacctttggcgacggcggcaccaccaaggacgtctggctcgcctggcgcgagaagtgg
 S   T   F   G   D   G   G   T   T   K   D   V   W   L   A   W   R   E   K   W gccaacaaggtctacctcgtcccggacttcgaccagacccagggctactacgaggccgcg
 A   N   K   V   Y   L   V   P   D   F   D   Q   T   Q   G   Y   Y   E   A   A cccggctggtggagccactggggcgacgtcgtcgacgggctcttcagctgggagtcgacc
 P   G   W   W   S   H   W   G   D   V   V   D   G   L   F   S   W   E   S   T tggccgtgggcgggcgcgcgcagcacggccgacgcctcgctcgaccaggccgtcgcggcg
 W   P   W   A   G   A   R   S   T   A   D   A   S   L   D   Q   A   V   A   A ggcgcgcggcagcgcaagaaggcgtacatgatggggctcagcctgctgcagtacaagaac
 G   A   R   Q   R   K   K   A   Y   M   M   G   L   S   L   L   Q   Y   K   N gcgtacggggcgcgggtctggcgcgcgggcgaggacctgctcccgcagcgcatgacgagc
 A   Y   G   A   R   V   W   R   A   G   E   D   L   L   P   Q   R   M   T   S atcctggccatgtcgccgccgcccgactacgtcgagctcctgacgtggaacgacgggccc
 I   L   A   M   S   P   P   P   D   Y   V   E   L   L   T   W   N   D   G   P gagagccactacgtcggcagcctgtggccggagcagaacggcgaccgcgagcccgccgcc
 E   S   H   Y   V   G   S   L   W   P   E   Q   N   G   D   R   E   P   A   A tacgccaacggcgccgcgccccacaccgccctgcagccgctgctggcctccttcatcgcc
 Y   A   N   G   A   A   P   H   T   A   L   Q   P   L   L   A   S   F   I   A gcgtacaaggccggccgcgggcccgccgccatgcgcccgccccagctgacccccgcccgc
 A   Y   K   A   G   R   G   P   A   A   M   R   P   P   Q   L   T   P   A   R cccgtcgtcggcgccatctggtacaagcccgtcagctcgcagacgctgtgccccggcgcg
 P   V   V   G   A   I   W   Y   K   P   V   S   S   Q   T   L   C   P   G   A ggtccgtccgcgcaggagccgctgggctatggcgcggcgagggacgttgtcgcgtacggc
 G   P   S   A   Q   E   P   L   G   Y   G   A   A   R   D   V   V   A   Y   G
```

-continued

```
gtcgtcgtcggggctggcagcgatgtcgccggctggaagctcaggatgtggagcggggc
 V  V  V  G  A  G  S  D  V  A  G  W  K  L  R  M  W  S  G  G gtgcaggtcggggccgcggtgccgctcgtgccgggcctgaacagcggcgtcttcggtgcg
 V  Q  V  G  A  A  V  P  L  V  P  G  L  N  S  G  V  F  G  A ctgaatccgggcggccagaggctggaggtgctgaataaggagaacagggttgtcatgagg
 L  N  P  G  G  Q  R  L  E  V  L  N  K  E  N  R  V  V  M  R gctgctggcggcaggtgcgtgacaaagacttgtccggacggcatctacaacctgaatcct
 A  A  G  G  R  C  V  T  K  T  C  P  D  G  I  Y  N  L  N  P caggtcgtggggctgcagatgggcgcggattatcctgcatgtcggccatga
 Q  V  V  G  L  Q  M  G  A  D  Y  P  A  C  R  P  -
```

SEQ ID NO: 246
LENGTH: 416
TYPE: PRT
ORGANISM: M. phaseolina
MGLDGFALNIGDPTQPFVRRTLDSMFNYTRDRHPKFKHFFSLDLWAAGGAGKRLEDYDGLLRDFMGHAAYQKG

ANGFPFVSTFGDGGTTKDVWLAWREKWANKVYLVPDFDQTQGYYEAAPGWWSHWGDVVDGLFSWESTWPWAGA

RSTADASLDQAVAAGARQRKKAYMMGLSLLQYKNAYGARVWRAGEDLLPQRMTSILAMSPPPDYVELLTWNDG

PESHYVGSLWPEQNGDREPAAYANGAAPHTALQPLLASFIAAYKAGRGPAAMRPPQLTPARPVVGAIWYKPVS

SQTLCPGAGPSAQEPLGYGAARDVVAYGVVVGAGSDVAGWKLRMWSGGVQVGAAVPLVPGLNSGVFGALNPGG

QRLEVLNKENRVVMRAAGGRCVTKTCPDGIYNLNPQVVGLQMGADYPACRP*

SEQ ID NO: 247
LENGTH: 2020 (including 150 bp 5' UTR and 150 bp 3' UTR)
TYPE: DNA
ORGANISM: M. phaseolina
GCAGAACCCGCCGGCCATGACTCCAATACCCCTCAAGTCAGTGGCCATAGAGGAGCGTGGTGGCACCGGAGGA

GCTGTATAAAAGGCGATGCTACACCAGTTAATATTGCCATCAAGCACACAATCTCTCATTCATCACTCCTCAT

CATCATGGCTTCCAGTCGCGGCTTCCCGGCCGCCTTGGTCTTCTTTCTTGTCCTCACCACCGCCAATTTGGGA

GCAGCCAAGGCATTGACCAAAGGTGTTTTTGCCCACTATATGGTAAACTGATTGCTTCTTTCAACTGCTGAAG

CCCTCACTGACGCATTCCCAGGTTGGAAACGTGTACGAAGACCATGCTCACCAAGACATCAAAGATGCCTTAG

ACATGAATCTCGACGGATTCGCCCTGAACATTGGCGACCCCTCGCAGGATTTCGTGCGCAAGACGTTGAACTA

CATGTTCGACTACGCCCGCGACAATTACCCCGACTTCAAACTCTTTATTAGCATGGATCTATGGGCAGCAGGC

TCCGCAAAGAAAGGCTTAGATGACTTCGATAGTCTCCTCCGGGACTACATCGGTCATGCCGCTTACTATAAAG

GCCCGAATGGGTTTCCATTTATTAGCACCTTTGCCGACGGCGGTCTCGAGAACACCACATGGATGGACTGGAG

GAATAAGTGGGCGAACGAAATTTACTTCATCCCCGATTTTGACGGTTCAGCAGGCTACTACAAGTCTGACCCT

GCCTGGTGGGAGTACTGGGGAGGCGTCGTCGATGGCATCTTCAGCTGGGAATCTACTTGGCCTCTGCGGGCA

GCACCAAGACGTCTTATTGGAAAAATGAGACATGGGTAAGGGAAGGCGCGTTTTCGCACGATAAGGCGTACAT

GATGGGTAAGTTTTCTGTCCACATAGAGTTTTCACCGGCTAACATTTGGCTACCCAGGCTTGAGCATGCTGCA

GTACAAGAACTCGGTGGGTCTTGCGGGCTTTCGCTTCGACCTGAGCCTCAGGAACTGACCGCGTGCTTGATTT

AGTACGAGACGAATCTTTACCGAGCCGGCGAAGACAACCTGTCCTGGAGAATTTTCAACCTTCAGCAGATGGC

CCCAGCGCCCGACTTTATTGAGATCCTGACATGGGTGAGAGCTCTCGCAAAGTAATAGTTCCACGTTGACGAC

TGACTTTATTCTAGAACGACGGCCCCGAAAGCCATTACATCGGCAACATCTGGCCGGAGCAGAATAATGAGAC

CGATCCGGCCAGATACGCCACCCAGGATACCTTCCCCCACGACGGTATCCGTCCCTTGCTGTCCTCCTTTATC

AGCTCTTATAAGGCTGGAAAGGAAATCATGGAGCCTCCGACTGGTTACGATGCGGTTGGTGCGCTGTGGTACA

AGTCCATCCACTCGAGCACTGTGTGCCCGGACACCGACGACCTCATCAGCAAGAAACCGGATGGCTACTCGGC

CGCCTCCGACGTCCTCACATGGGCCGTCATCGTCAGCTCCATTGGAGGACCCTATAACATTCGCGGCTACAGC

GGCGGGCAAGAATTGGAGACGTTCTACCTCACGGCCGGCTATAACTTCGGCACCTTTTCCTCACTGCAAGAAG

GCGACCAGCGCATGGAGCTCCTCGACTCCACCGGAAAGGTTATTATGGCGGCATCGGGCGGCCGCTGCGTTAC
```

-continued

```
GTCTACCTGCCCGGATGGCATCTATAACCTCAACCCGCAGGTTCTCGAGCTTGTCATGGACACATCGGAGAAG

ACGTGCACTGAGCCTATTACTGAAATGTACCCTCCGATATCTACGACCGCAACCTGGGGAACGAGATTGTTTG

GTTTCAAGTATATCCTTCTATTCTTCGCATCTTCGTGATTGCTGACGTCTTGTAAAGCGGATGTCAACCGGGG

ATGAAGGCGGCTATCCAGCGGGCGTACGACGACTTCCACAGGCTGACCGACCAAAACGGTGTGGGTGACAAGA

TTGACTGGACCAGCGCTGCCGCGCTCGAGCTCTTGGCGCCTCCCTGTAT
```

SEQ ID NO: 248
LENGTH: 1350
TYPE: DNA
ORGANISM: M. phaseolina
FEATURE NAME/KEY: CDS
LOCATION: (1)...(1350)

```
atggcttccagtcgcggcttcccggccgccttggtcttctttcttgtcctcaccaccgcc
 M   A   S   S   R   G   F   P   A   A   L   V   F   F   L   V   L   T   T   A aatttgggagcagccaaggcattgaccaaaggtgttttgcccactatatggttggaaac
 N   L   G   A   A   K   A   L   T   K   G   V   F   A   H   Y   M   V   G   N gtgtacgaagaccatgctcaccaagacatcaaagatgccttagacatgaatctcgacgga
 V   Y   E   D   H   A   H   Q   D   I   K   D   A   L   D   M   N   L   D   G ttcgccctgaacattggcgacccctcgcaggatttcgtgcgcaagacgttgaactacatg
 F   A   L   N   I   G   D   P   S   Q   D   F   V   R   K   T   L   N   Y   M ttcgactacgcccgcgacaattaccccgacttcaaactctttattagcatggatctatgg
 F   D   Y   A   R   D   N   Y   P   D   F   K   L   F   I   S   M   D   L   W gcagcaggctccgcaaagaaaggcttagatgacttcgatagtctcctccgggactacatc
 A   A   G   S   A   K   K   G   L   D   D   F   D   S   L   L   R   D   Y   I ggtcatgccgcttactataaaggcccgaatgggtttccatttattagcacctttgccgac
 G   H   A   A   Y   Y   K   G   P   N   G   F   P   F   I   S   T   F   A   D ggcggtctcgagaacaccacatggatggactggaggaataagtgggcgaacgaaatttac
 G   G   L   E   N   T   T   W   M   D   W   R   N   K   W   A   N   E   I   Y ttcatccccgattttgacggttcagcaggctactacaagtctgaccctgcctggtgggag
 F   I   P   D   F   D   G   S   A   G   Y   Y   K   S   D   P   A   W   W   E tactggggaggcgtcgtcgatggcatcttcagctgggaatctacttggcctctgcggggc
 Y   W   G   G   V   V   D   G   I   F   S   W   E   S   T   W   P   L   R   G agcaccaagacgtcttattggaaaaatgagacatgggtaagggaaggcgcgttttcgcac
 S   T   K   T   S   Y   W   K   N   E   T   W   V   R   E   G   A   F   S   H gataaggcgtacatgatggccattacatcggcaacatctggccgagcagaataatgaga
 D   K   A   Y   M   M   A   I   T   S   A   T   S   G   R   S   R   I   M   R ccgatccggccagatacgccacccaggataccttcccccacgacggtatccgtcccttgc
 P   I   R   P   D   T   P   P   R   I   P   S   P   T   T   V   S   V   P   C tgtcctcctttatcagctcttataaggctggaaaggaaatcatggagcctccgactggtt
 C   P   P   L   S   A   L   I   R   L   E   R   K   S   W   S   L   R   L   V acgatgcggttggtgcgctgtggtacaagtccatccactcgagcactgtgtgcccggaca
 T   M   R   L   V   R   C   G   T   S   P   S   T   R   A   L   C   A   R   T ccgacgacctcatcagcaagaaaccggatggctactcggccgcctccgacgtcctcacat
 P   T   T   S   S   A   R   N   R   M   A   T   R   P   P   P   T   S   S   H gggccgtcatcgtcagctccattggaggaccctataacattcgcggctacagcggcgggc
 G   P   S   S   S   A   P   L   E   D   P   I   T   F   A   A   T   A   A   G aagaattggagacgttctacctcacggccggctataacttcggcaccttttcctcactgc
 K   N   W   R   R   S   T   S   R   P   A   I   T   S   A   P   F   P   H   C aagaaggcgaccagcgcatggagctcctcgactccaccggaaaggttattatggcggcat
 K   K   A   T   S   A   W   S   S   S   T   P   P   E   R   L   L   W   R   H cgggcggccgctgcgttacgtctacctgcccggatggcatctataacctcaacccgcagg
 R   A   A   A   A   L   R   L   P   A   R   M   A   S   I   T   S   T   R   R ttctcgagcttgtcatggacacatcggagaagacgtgcactgagcctattactgaaatgt
 F   S   S   L   S   W   T   H   R   R   R   R   A   L   S   L   L   L   K   C
```

-continued

```
accctccgatatctacgaccgcaacctggggaacgagattgtttggtttcaagtatatcc
 T  L  R  Y  L  R  P  Q  P  G  E  R  D  C  L  V  S  S  I  S ttctattcttcgcatcttcgtgattgctga
 F  Y  S  S  H  L  R  D  C  -
```

SEQ ID NO: 249
LENGTH: 449
TYPE: PRT
ORGANISM: *M. phaseolina*
MASSRGFPAALVFFLVLTTANLGAAKALTKGVFAHYMVGNVYEDHAHQDIKDALDMNLDGFALNIGDPSQDFV

RKTLNYMFDYARDNYPDFKLFISMDLWAAGSAKKGLDDFDSLLRDYIGHAAYYKGPNGFPFISTFADGGLENT

TWMDWRNKWANEIYFIPDFDGSAGYYKSDPAWWEYWGGVVDGIFSWESTWPLRGSTKTSYWKNETWVREGAFS

HDKAYMMAITSATSGRSRIMRPIRPDTPPRIPSPTTVSVPCCPPLSALIRLERKSWSLRLVTMRLVRCGTSPS

TRALCARTPTTSSARNRMATRPPPTSSHGPSSSAPLEDPITFAATAAGKNWRRSTSRPAITSAPFPHCKKATS

AWSSSTPPERLLWRHRAAAALRLPARMASITSTRRFSSLSWTHRRRRALSLLLKCTLRYLRPQPGERDCLVSS

ISFYSSHLRDC*

SEQ ID NO: 250
LENGTH: 1945 (including 150 bp 5' UTR and 150 bp 3' UTR)
TYPE: DNA
ORGANISM: *M. phaseolina*
TGGACGCCCGTCATTCCACCTTGATCCTGCTCCCTCCCGGGCAATATAAATCCGACCTAGCAAGCTGAACCTC

ATCTGCTCCTTTGCAACCCACATCTGCTTCGCCGACACCACTTCCATATCCTTTCTACGCTGCCGAACTCTGC

CAGTATGGAGTTTGCCCTTGTCTTTGCGCTGGTCCTTGGCGCCCTCAGCCAGTCCGTTTCTACTGCCCTGGTC

ATTTCCAGCTTCGAGGTAATTGCTTCTAGACAGACTTGCAGACTCTGCTTACCTTGCCACAGCTTATATTCGC

CGAAACCTACACTGTCGACACCTGGAAGACTGACATTGCCTCAGCTAAAGCAGCAGGAATTGATGGCTTCGGT

GCGTCTCGACCATTTCGTCTCGGCTCCCGAACTGTCACACTGACATTTGAATCCGTAGCTCTGGTCGCGGTTC

CTCCCAACTGTCAATCCCAAGACTTGAGCTGGCAGACTGCCAGGATCAAGGATGCATACACTGCTGCAGATAT

TGAGAACTTTTCGATCGTTCCGGCCTTTGACATGAGTTATAGTTTCCGTACAGAGAATTGTCCAACCGGTATC

GCCTGGAACATGACGTACATGTCGACCATCATCTCGGATGCCAGCAAACAGGCCGCGACCTACCGCTGGAAAG

ATACTGTGCTGATCATCACCGGGGACAGTGGCCTCTATGCCGACGACTACTTCTCCCAGATGAAATCTCTCCT

CAATCGTCAGGGGGTTAATATCAGCGTCGCTCCGTACATCGAGAAGTATGTGGAAGCAGCTACTCGCTACGGT

GAACCCGATAAGGACGCGAAATTTGCCTTCTTGGACTATCCTTCTATCGATGGCTTTTACAACGGTTAGTAGA

GAACTCCTAGAGTCTAACGGTGCAAAACTAATTGATAAACAAAGAATTGGCCTGGCCGATGAATGTCCGCCAA

AACCTGACCTGCGACGTTGATAACGCTTTCAAGGCTGCCATGGAAAAGGCGGGAAGGACCGGCCCGTACATAA

TGGCCGTCTCACCGTGGTACTACGAGAATCGCAACACCAACAATCCTGCCGACAGCCGCGTCCAGTACAGTGA

CACCCTTTGGTACTACCGCTGGAGTGGTGTCATCAACGATACGAAGCCCGACATTGTGAATATCGTAAGCTGG

AACAGCTGGAATACCTCATCTTACCTTCGCGATGTACCCCAGGAGAATGGCACTTCCCCTGGTTGCGTCAGCC

TCGGCGAGCAAGGCAACTACGTCTACGGCATGAACCACTCGGCTTGGCGGGACATGAGTGCTCATTATGCCAA

CTACTACAAGACCGGGACTGAACCTGAGCTCAAGGACAACAAACTGATCTACTGGTACCGCGTACACCGTAAG

AATGCGAAGTGCAGTGGTGGCCAAAGTTCCGCGACAGGCACAGTCCAGAACTCCGATTTCCCTGATGACTCGG

TCTTCATCTGGGCCGCTGTGCGTGCCGAGGTCGAGATCGAAGTCTTTTACGGCAATGCTCCCGACTCGCAAGA

CATGAGGCCTGGCTCTCCCAAGGTGACCTTCACGACGGCCAACCAGACTGGACCCCAACTCTTTGAGCTGCCG

TTCCCTCAAGAtTTCCCGTTGAATAGCAGCGATATCCTCTACCCGCACGTCCTGGTCTATCCGACCAACATCC

GCCGCATTGCGTACTCGAAGTACAACAGCGTGCCGATCACGGCGGAGTGCTCTTGGGAGAATTTCAATCCGGT

GGTCCAGAGCTTGGGGGATGATTTCAACGAGATCATGGGGTAACTTCGGGGAGCATCAGCGTGGGACACGCGA

AGATGCCAGGAGAGCTTGAGAAGACGGCATGACTGAACGACGAGAACGAGCATAACCGCAATGCACCTTGCTA

TCGAAGAACAATGATTTCCATTCCCTGATGCTGCCGTGTACAACTTC

SEQ ID NO: 251
LENGTH: 1485
TYPE: DNA
ORGANISM: M. phaseolina
FEATURE NAME/KEY: CDS
LOCATION: (1)...(1485)

```
atggagtttgcccttgtctttgcgctggtccttggcgccctcagccagtccgtttctact
 M   E   F   A   L   V   F   A   L   V   L   G   A   L   S   Q   S   V   S   T gccctggtcatttccagcttcgagcttatattcgccgaaacctacactgtcgacacctgg
 A   L   V   I   S   S   F   E   L   I   F   A   E   T   Y   T   V   D   T   W aagactgacattgcctcagctaaagcagcaggaattgatggcttcgctctggtcgcggtt
 K   T   D   I   A   S   A   K   A   A   G   I   D   G   F   A   L   V   A   V cctcccaactgtcaatcccaagacttgagctggcagactgccaggatcaaggatgcatac
 P   P   N   C   Q   S   Q   D   L   S   W   Q   T   A   R   I   K   D   A   Y actgctgcagatattgagaacttttcgatcgttccggcctttgacatgagttatagtttc
 T   A   A   D   I   E   N   F   S   I   V   P   A   F   D   M   S   Y   S   F cgtacagagaattgtccaaccggtatcgcctggaacatgacgtacatgtcgaccatcatc
 R   T   E   N   C   P   T   G   I   A   W   N   M   T   Y   M   S   T   I   I tcggatgccagcaaacaggccgcgacctaccgctggaaagatactgtgctgatcatcacc
 S   D   A   S   K   Q   A   A   T   Y   R   W   K   D   T   V   L   I   I   T ggggacagtggcctctatgccgacgactacttctcccagatgaaatctctcctcaatcgt
 G   D   S   G   L   Y   A   D   D   Y   F   S   Q   M   K   S   L   L   N   R caggggttaatatcagcgtcgctccgtacatcgagaagtatgtggaagcagctactcgc
 Q   G   V   N   I   S   V   A   P   Y   I   E   K   Y   V   E   A   A   T   R tacggtgaacccgataaggacgcgaaatttgccttcttggactatccttctatcgatggc
 Y   G   E   P   D   K   D   A   K   F   A   F   L   D   Y   P   S   I   D   G ttttacaacgaattggcctggccgatgaatgtccgccaaaacctgacctgcgacgttgat
 F   Y   N   E   L   A   W   P   M   N   V   R   Q   N   L   T   C   D   V   D aacgctttcaaggctgccatggaaaaggcgggaaggaccggcccgtacataatggccgtc
 N   A   F   K   A   A   M   E   K   A   G   R   T   G   P   Y   I   M   A   V tcaccgtggtactacgagaatcgcaacaccaacaatcctgccgacagccgcgtccagtac
 S   P   W   Y   Y   E   N   R   N   T   N   N   P   A   D   S   R   V   Q   Y agtgacacccttggtactaccgctggagtggtgtcatcaacgatacgaagcccgacatt
 S   D   T   L   W   Y   Y   R   W   S   G   V   I   N   D   T   K   P   D   I gtgaatatcgtaagctggaacagctggaatacctcatcttaccttcgcgatgtaccccag
 V   N   I   V   S   W   N   S   W   N   T   S   S   Y   L   R   D   V   P   Q gagaatggcacttcccctggttgcgtcagcctcggcgagcaaggcaactacgtctacggc
 E   N   G   T   S   P   G   C   V   S   L   G   E   Q   G   N   Y   V   Y   G atgaaccactcggcttggcgggacatgagtgctcattatgccaactactacaagaccggg
 M   N   H   S   A   W   R   D   M   S   A   H   Y   A   N   Y   Y   K   T   G actgaacctgagctcaaggacaacaaactgatctactggtaccgcgtacaccgtaagaat
 T   E   P   E   L   K   D   N   K   L   I   Y   W   Y   R   V   H   R   K   N gcgaagtgcagtggtggccaaagttccgcgacaggcacagtccagaactccgatttccct
 A   K   C   S   G   G   Q   S   S   A   T   G   T   V   Q   N   S   D   F   P gatgactcggtcttcatctgggccgctgtgcgtgccgaggtcgagatcgaagtcttttac
 D   D   S   V   F   I   W   A   A   V   R   A   E   V   E   I   E   V   F   Y ggcaatgctcccgactcgcaagacatgaggcctggctctcccaaggtgaccttcacgacg
 G   N   A   P   D   S   Q   D   M   R   P   G   S   P   K   V   T   F   T   T gccaaccagactggaccccaactctttgagctgccgttccctcaagatttcccgttgaat
 A   N   Q   T   G   P   Q   L   F   E   L   P   F   P   Q   D   F   P   L   N agcagcgatatcctctacccgcacgtcctggtctatccgaccaacatccgccgcattgcg
 S   S   D   I   L   Y   P   H   V   L   V   Y   P   T   N   I   R   R   I   A tactcgaagtacaacagcgtgccgatcacggcggagtgctcttgggagaatttcaatccg
 Y   S   K   Y   N   S   V   P   I   T   A   E   C   S   W   E   N   F   N   P gtggtccagagcttgggggatgatttcaacgagatcatggggtaa
 V   V   Q   S   L   G   D   D   F   N   E   I   M   G   -
```

SEQ ID NO: 252
LENGTH: 494
TYPE: PRT
ORGANISM: M. phaseolina
MEFALVFALVLGALSQSVSTALVISSFELIFAETYTVDTWKTDIASAKAAGIDGFALVAVPPNCQSQDLSWQT

ARIKDAYTAADIENFSIVPAFDMSYSFRTENCPTGIAWNMTYMSTIISDASKQAATYRWKDTVLIITGDSGLY

ADDYFSQMKSLLNRQGVNISVAPYIEKYVEAATRYGEPDKDAKFAFLDYPSIDGFYNELAWPMNVRQNLTCDV

DNAFKAAMEKAGRTGPYIMAVSPWYYENRNTNNPADSRVQYSDTLWYYRWSGVINDTKPDIVNIVSWNSWNTS

SYLRDVPQENGTSPGCVSLGEQGNYVYGMNHSAWRDMSAHYANYYKTGTEPELKDNKLIYWYRVHRKNAKCSG

GQSSATGTVQNSDFPDDSVFIWAAVRAEVEIEVFYGNAPDSQDMRPGSPKVTFTTANQTGPQLFELPFPQDFP

LNSSDILYPHVLVYPTNIRRIAYSKYNSVPITAECSWENFNPVVQSLGDDFNEIMG*

SEQ ID NO: 253
LENGTH: 2805 (including 150 bp 5' UTR and 150 bp 3' UTR)
TYPE: DNA
ORGANISM: M. phaseolina
CAGCGTCACTAGCTCGAGATATGTCGGTAGCAGGTGAGGGTTACAGTCGGGTCCCAGAGTGGGATGGCATCAA

CATGTAAAAATGTCACCCTCGTGCTCTGCTTCTGCCAGCCCAGCGCCTCTCCTGCTGCCCTGCGCCTCAGCTC

GGCCATGATCTCCCTGACATTCGATGCCGTGTGCCTCCTGGCTGCCGCCGCTGGCTGCCTTGCCGCTCCGTCC

CGACGCGACTGGCTCGGTGCCGCTTCCAGTGATGTGAGACCAACACCACTGAGCTGATTGCGACGCTGGCTGA

CGTGGATTAGGTCGTGACCGTGTCTCTGCTCCAATCCCTCAACAACAGAGCCTTCGGCCACTTCCCCGGGGAT

GCCGACTTCGACGGCTCCGCGCAGTCTTATCCGGCCTCCGAGCTGCAGTACTCGGGTTCCTTCACTTCGACCG

CAACGGGGGTCGAATATCTCTTTCCCGCCTCCCAAGCTTCGAACGCCAGCGACAACGTGCTGTGCCTTGGTCA

GACCATCTCGGTCCCGGCAGCATCTTATCTGAGCGCCCAGCTCCTGGTGGCTAGCGACAAGAGGGACACCATC

GTGTCCGACAACATCACCTTCACCTACGCCGACAACACCTCCTCCGTGGCGGAGATCCGTGCCGAGCCATGGT

GGGCCTTCTTGACTATGTACAAGGGCGAAGTGATTTTGCCGTACCGCTACCTTGCCAATGATACCAACTTCAA

CACCACCCATGTTTACGAGTGGTCTGGCGCTTTGGATCCCTCAAAGCAGCTGGCCTCCATCACTCTGCCATCC

ACCAGCAATACCACTACTGGGCGTATGCACGTCTTCGCTTTGTCCCTGCGCAGCCCCTCCGGGCTTCGCGCCC

AACACATTCGCCCCACCCAGAAGCAGGAGGAGGGCAATGTGCAGATCGTTGAGGTGACTGTCGGCAATTCTGG

CCCAGGCTGGGTCCATGGTGGCGGAGTGTGGGTCACTGTCGAGGCTCCTGGCGTTAGGACGGTCAGGCCAGCT

CAGATCAAACGCCTGCGCGCCGGCGACCAGAAGAAGGTGAACGTGGGCGTCGTGGGGTCCTCGCGCTCCACTG

CCACCGTCAGACTGTCAAATGGAAACGAGACCACCAGTTTCACCTTTCCCGATGTCGACTTCGGCCTGAAGAA

TTACACCGAGTCGCTGGACAGCCTGACGCTGCATGAATCTCCCGACTGGTTCAACAACGCCAAGTTTGGTATT

TTTATCCACTGGGGCCCTTATGCCGTGCCTGGTTGGGGGAACTCAACCCCCTACGAAGTATATGCGGAGTGGT

ACTGGTGGTACTCCCATCACCTCGCCGCTGACAAGGCCGACACCTACGACTATCACCTGCGCACCTTTGGCCC

CGACGTCAACTACGACGACTTCTTCGTCAATTTCACTGCTGCAAACTTCGATCCTAAGGCTTGGGTCGATCTG

TTTGATGATGCCGGTGCCCAGTATTTCGTACTGACCACCAAGGTTTGTTTTGAGCGGTCCTAGTCACCGTTTC

CCTGCAGGCTGACGCTCTTCAGCATCATGATGGCTTTGCGCTGTTCGACCCGAAGGAGACGTCCAACAGAAGC

GCGCTAAACTACGGGCCCAAGCGAGATCTCCTGAAGGAACTGTTTGACGCAGCAAAAACCTACCAGCCCCACC

TGCACCGCGGCACCTATTTCTCCTTGCCCGAATGGTATAACCCAGATTTCGGGTACGGGCCCTCGGCGCTCTT

CCGCTTGAAGACGTATACTGACCGCTGTGCAGACCCTACGGCTTCGCGCAAAACGAAGGAAACGCGTCGACAT

CATGGCCCGGCATCTTGGCGACGAACCAGTACACTGGCGAAACGGAACCCTACACTGGACACGTTCCCGTCGC

CGACTTCATCGCTGATCTCATGGTCCCGCAGCAGGAGATCTTGGCCTACGACTACGAAACGGACATCATGTGG

TGCGACTGTGGTGCCGCCAATGGCTCGGCTGCCTTCGCATCCGAGTGGTTCAACCGCGCCGCCGCTGCCGGAA

GGCAGGTCACGATGAACAGCCGCTGTGGCATCGCCCAGGGCAGCGACTTCGACACGCCCGAGTACACCACCTT

CAGTAGCGTGTCGCCCCGCAAGTGGGAGAGCAATCAGGGTATGGATCCCTACAGCTACGGCTACAACCGCGCC

-continued

ACGGCCGACAGCGCGTACATGAACGCGTCCACGGTCGTCGCTTCCCTCGTCGACATGGTCTCAAAGAACGGCA

ACTTCCTGCTCGATATCGGTCCGAGGGCCGACGGCTCCATCGTCGAGGTCGAGGCACAGAACCTGCGCGAGGC

CGGCAAGTGGATCAAGAAGCATGGCGAGGCCGTCTTCAACACGACTTACTGGTTTGTCATGCCCGAGCTGGAC

AGCATCAGGTTCACCCAGACCAACGACGCCTTCTACCTCCTGTTCTTGGAGGAGCCGGTCGCTGGCCAGGACG

TGCTGGTCGAGGCGCCGCTGCCAGTTTTGCCTGGAGACAAGGTCACGGTGCTTGGTGAAGGGCTGGATGTCGA

ATGGAAGACGGTAGGTAGTGGTGTGAGCTTGACATGGCCTGCGAAAATGGAAGGTAAAGGTGAGTATTGCTGG

GTGGTGAAGATTGAGTATGCTGCATGACTTTTCTTGTAAGCTGTACGATGACTCAATACTTTACACTCAAACG

TTTGATCCTCACTCAAATGGAAAGATTGTCCTGCGCTTTCGCGAGCCATTGTAATATCTATAGCCTGGTTGGT

AATATCGGCTCGACCCTTTCAATCTGCCGGC

SEQ ID NO: 254
LENGTH: 2349
TYPE: DNA
ORGANISM: M. phaseolina
FEATURE NAME/KEY: CDS
LOCATION: (1)...(2349)

```
atgatctccctgacattcgatgccgtgtgcctcctggctgccgccgctggctgccttgcc
 M   I   S   L   T   F   D   A   V   C   L   L   A   A   A   A   G   C   L   A gctccgtcccgacgcgactggctcggtgccgcttccagtgatgtcgtgaccgtgtctctg
 A   P   S   R   R   D   W   L   G   A   A   S   S   D   V   V   T   V   S   L ctccaatccctcaacaacagagccttcggccacttccccggggatgccgacttcgacggc
 L   Q   S   L   N   N   R   A   F   G   H   F   P   G   D   A   D   F   D   G tccgcgcagtcttatccggcctccgagctgcagtactcggggttccttcacttcgaccgca
 S   A   Q   S   Y   P   A   S   E   L   Q   Y   S   G   S   F   T   S   T   A acggggtcgaatatctctttcccgcctcccaagcttcgaacgccagcgacaacgtgctg
 T   G   V   E   Y   L   F   P   A   S   Q   A   S   N   A   S   D   N   V   L tgccttggtcagaccatctcggtcccggcagcatcttatctgagcgcccagctcctggtg
 C   L   G   Q   T   I   S   V   P   A   A   S   Y   L   S   A   Q   L   L   V gctagcgacaagagggacaccatcgtgtccgacaacatcaccttcacctacgccgacaac
 A   S   D   K   R   D   T   I   V   S   D   N   I   T   F   T   Y   A   D   N acctcctccgtggcggagatccgtgccgagccatggtgggccttcttgactatgtacaag
 T   S   S   V   A   E   I   R   A   E   P   W   W   A   F   L   T   M   Y   K ggcgaagtgattttgccgtaccgctaccttgccaatgataccaacttcaacaccacccat
 G   E   V   I   L   P   Y   R   Y   L   A   N   D   T   N   F   N   T   T   H gtttacgagtggtctggcgcttttggatccctcaaagcagctggcctccatcactctgcca
 V   Y   E   W   S   G   A   L   D   P   S   K   Q   L   A   S   I   T   L   P tccaccagcaataccactactgggcgtatgcacgtcttcgctttgtccctgcgcagcccc
 S   T   S   N   T   T   T   G   R   M   H   V   F   A   L   S   L   R   S   P tccgggcttcgcgcccaacacattcgccccacccagaagcaggaggagggcaatgtgcag
 S   G   L   R   A   Q   H   I   R   P   T   Q   K   Q   E   E   G   N   V   Q atcgttgaggtgactgtcggcaattctggcccaggctgggtccatggtggcggagtgtgg
 I   V   E   V   T   V   G   N   S   G   P   G   W   V   H   G   G   G   V   W gtcactgtcgaggctcctggcgttaggacggtcaggccagctcagatcaaacgcctgcgc
 V   T   V   E   A   P   G   V   R   T   V   R   P   A   Q   I   K   R   L   R gccggcgaccagaagaaggtgaacgtgggcgtcgtggggtcctcgcgctccactgccacc
 A   G   D   Q   K   K   V   N   V   G   V   V   G   S   S   R   S   T   A   T gtcagactgtcaaatggaaacgagaccaccagtttcacctttcccgatgtcgacttcggc
 V   R   L   S   N   G   N   E   T   T   S   F   T   F   P   D   V   D   F   G ctgaagaattacaccgagtcgctggacagcctgacgctgcatgaatctcccgactggttc
 L   K   N   Y   T   E   S   L   D   S   L   T   L   H   E   S   P   D   W   F aacaacgccaagtttggtatttttatccactggggccctatgccgtgcctggttgggggg
 N   N   A   K   F   G   I   F   I   H   W   G   P   Y   A   V   P   G   W   G aactcaacccctacgaagtatatgcggagtggtactggtggtactcccatcacctcgcc
 N   S   T   P   Y   E   V   Y   A   E   W   Y   W   W   Y   S   H   H   L   A
```

```
gctgacaaggccgacacctacgactatcacctgcgcacctttggccccgacgtcaactac
 A  D  K  A  D  T  Y  D  Y  H  L  R  T  F  G  P  D  V  N  Y gacgacttcttcgtcaatttcactgctgcaaacttcgatcctaaggcttgggtcgatctg
 D  D  F  F  V  N  F  T  A  A  N  F  D  P  K  A  W  V  D  L tttgatgatgccggtgcccagtatttcgtactgaccaccaagcatcatgatggctttgcg
 F  D  D  A  G  A  Q  Y  F  V  L  T  T  K  H  H  D  G  F  A ctgttcgacccgaaggagacgtccaacagaagcgcgctaaactacgggcccaagcgagat
 L  F  D  P  K  E  T  S  N  R  S  A  L  N  Y  G  P  K  R  D ctcctgaaggaactgtttgacgcagcaaaaacctaccagccccacctgcaccgcggcacc
 L  L  K  E  L  F  D  A  A  K  T  Y  Q  P  H  L  H  R  G  T tatttctccttgcccgaatggtataacccagatttcggaccctacggcttcgcgcaaaac
 Y  F  S  L  P  E  W  Y  N  P  D  F  G  P  Y  G  F  A  Q  N gaaggaaacgcgtcgacatcatggcccggcatcttggcgacgaaccagtacactggcgaa
 E  G  N  A  S  T  S  W  P  G  I  L  A  T  N  Q  Y  T  G  E acggaaccctacactggacacgttcccgtcgccgacttcatcgctgatctcatggtcccg
 T  E  P  Y  T  G  H  V  P  V  A  D  F  I  A  D  L  M  V  P cagcaggagatcttggcctacgactacgaaacggacatcatgtggtgcgactgtggtgcc
 Q  Q  E  I  L  A  Y  D  Y  E  T  D  I  M  W  C  D  C  G  A gccaatggctcggctgccttcgcatccgagtggttcaaccgcgccgccgctgccggaagg
 A  N  G  S  A  A  F  A  S  E  W  F  N  R  A  A  A  A  G  R caggtcacgatgaacagccgctgtggcatcgcccagggcagcgacttcgacacgcccgag
 Q  V  T  M  N  S  R  C  G  I  A  Q  G  S  D  F  D  T  P  E tacaccacccttcagtagcgtgtcgccccgcaagtgggagagcaatcagggtatggatccc
 Y  T  T  F  S  S  V  S  P  R  K  W  E  S  N  Q  G  M  D  P tacagctacggctacaaccgcgccacggccgacagcgcgtacatgaacgcgtccacggtc
 Y  S  Y  G  Y  N  R  A  T  A  D  S  A  Y  M  N  A  S  T  V gtcgcttccctcgtcgacatggtctcaaagaacggcaacttcctgctcgatatcggtccg
 V  A  S  L  V  D  M  V  S  K  N  G  N  F  L  L  D  I  G  P agggccgacggctccatcgtcgaggtcgaggcacagaacctgcgcgaggccggcaagtgg
 R  A  D  G  S  I  V  E  V  E  A  Q  N  L  R  E  A  G  K  W atcaagaagcatggcgaggccgtcttcaacacgacttactggtttgtcatgcccgagctg
 I  K  K  H  G  E  A  V  F  N  T  T  Y  W  F  V  M  P  E  L gacagcatcaggttcacccagaccaacgacgccttctacctcctgttcttggaggagccg
 D  S  I  R  F  T  Q  T  N  D  A  F  Y  L  L  F  L  E  E  P gtcgctggccaggacgtgctggtcgaggcgccgctgccagttttgcctggagacaaggtc
 V  A  G  Q  D  V  L  V  E  A  P  L  P  V  L  P  G  D  K  V acggtgcttggtgaagggctggatgtcgaatggaagacggtaggtagtggtgtgagcttg
 T  V  L  G  E  G  L  D  V  E  W  K  T  V  G  S  G  V  S  L acatggcctgcgaaaatggaaggtaaaggtgagtattgctggtggtgaagattgagtat
 T  W  P  A  K  M  E  G  K  G  E  Y  C  W  V  V  K  I  E  Y gctgcatga
 A  A  -

SEQ ID NO: 255
LENGTH: 782
TYPE: PRT
ORGANISM: M. phaseolina
MISLTFDAVCLLAAAAGCLAAPSRRDWLGAASSDVVTVSLLQSLNNRAFGHFPGDADFDGSAQSYPASELQYS

GSFTSTATGVEYLFPASQASNASDNVLCLGQTISVPAASYLSAQLLVASDKRDTIVSDNITFTYADNTSSVAE

IRAEPWWAFLTMYKGEVILPYRYLANDTNFNTTHVYEWSGALDPSKQLASITLPSTSNTTTGRMHVFALSLRS

PSGLRAQHIRPTQKQEEGNVQIVEVTVGNSGPGWVHGGGVWVTVEAPGVRTVRPAQIKRLRAGDQKKVNVGVV

GSSRSTATVRLSNGNETTSFTFPDVDFGLKNYTESLDSLTLHESPDWFNNAKFGIFIHWGPYAVPGWGNSTPY

EVYAEWYWWYSHHLAADKADTYDYHLRTFGPDVNYDDFFVNFTAANFDPKAWVDLFDDAGAQYFVLTTKHHDG

FALFDPKETSNRSALNYGPKRDLLKELFDAAKTYQPHLHRGTYFSLPEWYNPDFGPYGFAQNEGNASTSWPGI
```

-continued

LATNQYTGETEPYTGHVPVADFIADLMVPQQEILAYDYETDIMWCDCGAANGSAAFASEWFNRAAAAGRQVTM

NSRCGIAQGSDFDTPEYTTFSSVSPRKWESNQGMDPYSYGYNRATADSAYMNASTVVASLVDMVSKNGNFLLD

IGPRADGSIVEVEAQNLREAGKWIKKHGEAVENTTYWFVMPELDSIRFTQTNDAFYLLFLEEPVAGQDVLVEA

PLPVLPGDKVTVLGEGLDVEWKTVGSGVSLTWPAKMEGKGEYCWVVKIEYAA*

SEQ ID NO: 256
LENGTH: 2600 (including 150 bp 5' UTR and 150 bp 3' UTR)
TYPE: DNA
ORGANISM: M. phaseolina
CCTTGGTGCCATTGTCTTCCGCACAGGCATTATTCATGCCGCAGAATGCCTTTCAACCTCTGGCAGGACAACC

TCTTTCATTCCCAGTGGACTTAAGTCCTTTGTTCAACAATCGTGGATTCGGGCTGACCCCCAACGAATCCGAT

TTTGATGGAATGGGCGGCAAGTTGCCGGCTTCGCATCACTCGAATCGAAGACTAATGCGCTACAGCTGCCTTC

CCTGCCGAGTCCATACCGCCATCCAGCTTTGTGTACTCGGGCTTCAACTACCAATTTCCGGAATATCGACAAA

CAGGAAATGACAATGTCATCGCAACTGGACAGACGCTCTCAGTGCCGCGCGGCAAATACATCAGCGTCGCATT

GCTCGCAGCCAGCGAAACCGGCCTTGCCTCAACCACTGTCAATGCTTCCTACGCTGATGAAGTGAGGGTTCT

GACGCAATCCTCGTGCCTGCTTGGTGGAACTGGCCGTATCCGGCTGGTGGCGACATCGTCCTCCCTTATCGAT

TGACCAACGAGACTGTCGACTATAATCGAACCAACATCTTCCACGTCACAGGCTGGCTGGATTCGAGCAAAGA

TCTTACTTCTCTGACTCTGCCAAACGTCACCGGAGGTTCCAGCACCTCTCCAGGCGGTGCTGCTGTTGAAGCA

AGGCTGCACATATTCGCCTTGTCACTCCTACCAGTGGCAAACACTCCTCCCCCGGGCCCCCAGCTGGAGGTTC

AGTATGCGAGGTCAACCCAGAAATGGATTGAAGGAACGAACAAGACTCAGATCTTCGAgGTCACCATCAACAA

CGTGGGCACGGACTTCGTACTGAAAGACCATTCAGTCTCCGTCTGGGTAGAGTCCGCCGGCGTGGAAACGGTA

ACAAATGCTACCGTCAAACGCTTAAGGCATGGAGATCAGGCCGTGGTGGAGGTAGGCGTCGTCAACAAAGGCG

GAGTTGAGCCAGGGACCGTCGGGAACGCAACTGTACATGTTGCCGGAGAAGGCATGCCGAGCACCGAGTACAC

CCTGAATGCAACGTTCGGCGTTGCAGACTATCAAGCCACCTACGATTCGGTATACTCCCATGAATCTCCCAGC

TGGTTTAACGATGCAAAATATGGGATTTTTATCCACTGGGGCGTCTATGCTGTGCCTGGATGGGGTAATTCCG

GCGAGAACGAAAGCTATGCTGAATGGTACTGGTGGCATCAGAACGAGGGACCGGGAACGTCTGTCGGAACCTG

GGAATACCACCTTGAAAATTATGGCCCCGACGTAGTCTACGATGACTTCATCCAAAACTTCACTGCCAGTGCT

TTCGATCCTAAGAGCTGGGTAGACCTCTTCGCCGATGCGGGTGCCCAATACTTCGTCCAAGTCTCCAAGCACC

ACGACGGTATGTGTGGACAGTGCCCACCTCACTTCACCCACTAAACACCACAGGCTACGCTATCTTCGACCTC

CCCGCCAACGTCTCGCAACGTACCTCCGTCGCCCTGCCGCCCCACCGCAACCTCCTCCAAGAGCTCTTCGACG

CCGCCTCAACCCACCAACCACAGCTCCACCGCGCCGTCTACTTCTCCCTCCCCGAATGGTTCCACCCCGACTA

TGCGCGCTATGGCTTCGGCGACTGGCCCGGTGGCAATGCCACGAATCCCTACACAAACGAATCCCTCCCCTAC

GCGGGCTACGTGCCCGTCGGTGACTACATCACCGACGTCATCGTTCCCGAAATGGACGCACTCGCCGACATGG

GCATCGAGATCATGGGTGCGACATCGGCGGGCCCAACGTCACCGCCGAGTGGGCGTCGAGCTGGTTCAACCG

CGCGGCCGCCGAAGGGCGCCAGGTCGTCATGAATGCGCGCTGCGGACTCCCTGGCGATTTCGACACGCCCGAG

TATGCGCGCTATGCGGGCGTGCAGGCGCGCAAGTGGGAGAGCAATCTCGGCATGGATCCGTACTCGTATGGGT

ATAATCGCGCGACGCCGGATGAGGCGTACATGAATGCGTCGGCGATTGTGAGGAGCTTGGTCGATATTGTGAG

CAAGAACGGGAACTTCCTGTTGGATGTCGGGCCCATGGAAAACGGCACGATCGTGGAGATTTGTCAGAGCAAT

TTGAGGGAGGCCGGTGAGTGGATTAAAGGACATGCAGAGGCGGTGTTTGGGACGAGGTATTGGAGCGTTACGC

CGCAGGAAgGGGAGAGTGTAAGGTTCACGACTACAGCGGATGCATTTTATATGCTGTTGTTGGAGAAGCCGGA

TGGAGAGCTCGTGCTGGAGAGCCCGGTGCCGTGGGTCGAGGGGGATGAGGTTACTGTTGTTGGTGGGAGTTTG

AACGGGACTGTGGTTCCAAGCCGGCAGCAAGATGATGGAAGAGTAGTTTTGGAAATCTCAGATGAGGTTGCTA

ATGGTGATCAGTTTGTGTGGGTATTTAAGATCACCTACTGAAGGGAAGGGCTCGGTACTACTCAGGCATCTGA

-continued
ATCCTGCGTCCATGCAAAGGCAGCCAGGGCCGTTCTCTGGCATATATCTGTATATGATCCTTCATAACGAGAT

CTCGTCTCCACAAATACGTCAGAAGCGTTCAACGACCAGTCGAGG

```
SEQ ID NO: 257
LENGTH: 2208
TYPE: DNA
ORGANISM: M. phaseolina
FEATURE NAME/KEY: CDS
LOCATION: (1)...(2208)
atggaatgggcggcaactgccttccctgccgagtccataccgccatccagctttgtgtac
 M  E  W  A  A  T  A  F  P  A  E  S  I  P  P  S  S  F  V  Y tcgggcttcaactaccaatttccggaatatcgacaaacaggaaatgacaatgtcatcgca
 S  G  F  N  Y  Q  F  P  E  Y  R  Q  T  G  N  D  N  V  I  A actggacagacgctctcagtgccgcgcggcaaatacatcagcgtcgcattgctcgcagcc
 T  G  Q  T  L  S  V  P  R  G  K  Y  I  S  V  A  L  L  A  A agcgaaaccggccttgcctcaaccactgtcaatgcttcctacgctgatggaagtgagggt
 S  E  T  G  L  A  S  T  T  V  N  A  S  Y  A  D  G  S  E  G tctgacgcaatcctcgtgcctgcttggtggaactggccgtatccggctggtggcgacatc
 S  D  A  I  L  V  P  A  W  W  N  W  P  Y  P  A  G  G  D  I gtcctcccttatcgattgaccaacgagactgtcgactataatcgaaccaacatcttccac
 V  L  P  Y  R  L  T  N  E  T  V  D  Y  N  R  T  N  I  F  H gtcacaggctggctggattcgagcaaagatcttacttctctgactctgccaaacgtcacc
 V  T  G  W  L  D  S  S  K  D  L  T  S  L  T  L  P  N  V  T ggaggttccagcacctctccaggcggtgctgctgttgaagcaaggctgcacatattcgcc
 G  G  S  S  T  S  P  G  G  A  A  V  E  A  R  L  H  I  F  A ttgtcactcctaccagtggcaaacactcctcccccgggcccccagctggaggttcagtat
 L  S  L  L  P  V  A  N  T  P  P  P  G  P  Q  L  E  V  Q  Y gcgaggtcaacccagaaatggattgaaggaacgaacaagactcagatcttcgaggtcacc
 A  R  S  T  Q  K  W  I  E  G  T  N  K  T  Q  I  F  E  V  T atcaacaacgtgggcacggacttcgtactgaaagaccattcagtctccgtctgggtagag
 I  N  N  V  G  T  D  F  V  L  K  D  H  S  V  S  V  W  V  E tccgccggcgtggaaacggtaacaaatgctaccgtcaaacgcttaaggcatggagatcag
 S  A  G  V  E  T  V  T  N  A  T  V  K  R  L  R  H  G  D  Q gccgtggtggaggtaggcgtcgtcaacaaaggcggagttgagccagggaccgtcgggaac
 A  V  V  E  V  G  V  V  N  K  G  G  V  E  P  G  T  V  G  N gcaactgtacatgttgccggagaaggcatgccgagcaccgagtacaccctgaatgcaacg
 A  T  V  H  V  A  G  E  G  M  P  S  T  E  Y  T  L  N  A  T ttcggcgttgcagactatcaagccacctacgattcggtatactcccatgaatctcccagc
 F  G  V  A  D  Y  Q  A  T  Y  D  S  V  Y  S  H  E  S  P  S tggtttaacgatgcaaaatatgggattttttatccactggggcgtctatgctgtgcctgga
 W  F  N  D  A  K  Y  G  I  F  I  H  W  G  V  Y  A  V  P  G tggggtaattccggcgagaacgaaagctatgctgaatggtactggtggcatcagaacgag
 W  G  N  S  G  E  N  E  S  Y  A  E  W  Y  W  W  H  Q  N  E ggaccgggaacgtctgtcggaacctgggaataccaccttgaaaattatggccccgacgta
 G  P  G  T  S  V  G  T  W  E  Y  H  L  E  N  Y  G  P  D  V gtctacgatgacttcatccaaaacttcactgccagtgctttcgatcctaagagctgggta
 V  Y  D  D  F  I  Q  N  F  T  A  S  A  F  D  P  K  S  W  V gacctcttcgccgatgcgggtgcccaatacttcgtccaagtctccaagcaccacgacggc
 D  L  F  A  D  A  G  A  Q  Y  F  V  Q  V  S  K  H  H  D  G tacgctatcttcgacctccccgccaacgtctcgcaacgtacctccgtcgccctgccgccc
 Y  A  I  F  D  L  P  A  N  V  S  Q  R  T  S  V  A  L  P  P caccgcaacctcctccaagagctcttcgacgccgcctcaacccaccaaccacagctccac
 H  R  N  L  L  Q  E  L  F  D  A  A  S  T  H  Q  P  Q  L  H cgcgccgtctacttctcctcccccgaatggttccaccccgactatgcgcgctatggcttc
 R  A  V  Y  F  S  L  P  E  W  F  H  P  D  Y  A  R  Y  G  F ggcgactggcccggtggcaatgccacgaatccctacacaaacgaatccctcccctacgcg
 G  D  W  P  G  G  N  A  T  N  P  Y  T  N  E  S  L  P  Y  A
```

```
ggctacgtgcccgtcggtgactacatcaccgacgtcatcgttcccgaaatggacgcactc
 G   Y   V   P   V   G   D   Y   I   T   D   V   I   V   P   E   M   D   A   L gccgacatgggcatcgagatcatgtggtgcgacatcggcgggcccaacgtcaccgccgag
 A   D   M   G   I   E   I   M   W   C   D   I   G   G   P   N   V   T   A   E tgggcgtcgagctggttcaaccgcgcggccgccgaagggcgccaggtcgtcatgaatgcg
 W   A   S   S   W   F   N   R   A   A   A   E   G   R   Q   V   V   M   N   A cgctgcggactccctggcgatttcgacacgcccgagtatgcgcgctatgcgggcgtgcag
 R   C   G   L   P   G   D   F   D   T   P   E   Y   A   R   Y   A   G   V   Q gcgcgcaagtgggagagcaatctcggcatggatccgtactcgtatgggtataatcgcgcg
 A   R   K   W   E   S   N   L   G   M   D   P   Y   S   Y   G   Y   N   R   A acgccggatgaggcgtacatgaatgcgtcggcgattgtgaggagcttggtcgatattgtg
 T   P   D   E   A   Y   M   N   A   S   A   I   V   R   S   L   V   D   I   V agcaagaacgggaacttcctgttggatgtcgggcccatggaaaacggcacgatcgtggag
 S   K   N   G   N   F   L   L   D   V   G   P   M   E   N   G   T   I   V   E atttgtcagagcaatttgagggaggccggtgagtggattaaaggacatgcagaggcggtg
 I   C   Q   S   N   L   R   E   A   G   E   W   I   K   G   H   A   E   A   V tttgggacgaggtattggagcgttacgccgcaggaaggggagagtgtaaggttcacgact
 F   G   T   R   Y   W   S   V   T   P   Q   E   G   E   S   V   R   F   T   T acagcggatgcattttatatgctgttgttggagaagccggatggagagctcgtgctggag
 T   A   D   A   F   Y   M   L   L   E   K   P   D   G   E   L   V   L   E agcccggtgccgtgggtcgaggggatgaggttactgttgttggtgggagttgaacggg
 S   P   V   P   W   V   E   G   D   E   V   T   V   V   G   G   S   L   N   G actgtggttccaagccggcagcaagatgatggaagagtagttttggaaatctcagatgag
 T   V   V   P   S   R   Q   Q   D   D   G   R   V   V   L   E   I   S   D   E gttgctaatggtgatcagtttgtgtgggtatttaagatcacctactga
 V   A   N   G   D   Q   F   V   W   V   F   K   I   T   Y   -

SEQ ID NO: 258
LENGTH: 735
TYPE: PRT
ORGANISM: M. phaseolina
MEWAATAFPAESIPPSSFVYSGFNYQFPEYRQTGNDNVIATGQTLSVPRGKYISVALLAASETGLASTTVNAS

YADGSEGSDAILVPAWWNWPYPAGGDIVLPYRLTNETVDYNRTNIFHVTGWLDSSKDLTSLTLPNVTGGSSTS

PGGAAVEARLHIFALSLLPVANTPPPGPQLEVQYARSTQKWIEGTNKTQIFEVTINNVGTDFVLKDHSVSVWV

ESAGVETVTNATVKRLRHGDQAVVEVGVVNKGGVEPGTVGNATVHVAGEGMPSTEYTLNATFGVADYQATYDS

VYSHESPSWFNDAKYGIFIHWGVYAVPGWGNSGENESYAEWYWWHQNEGPGTSVGTWEYHLENYGPDVVYDDF

IQNFTASAFDPKSWVDLFADAGAQYFVQVSKHHDGYAIFDLPANVSQRTSVALPPHRNLLQELFDAASTHQPQ

LHRAVYFSLPEWFHPDYARYGFGDWPGGNATNPYTNESLPYAGYVPVGDYITDVIVPEMDALADMGIEIMWCD

IGGPNVTAEWASSWFNRAAAEGRQVVMNARCGLPGDFDTPEYARYAGVQARKWESNLGMDPYSYGYNRATPDE

AYMNASAIVRSLVDIVSKNGNFLLDVGPMENGTIVEICQSNLREAGEWIKGHAEAVFGTRYWSVTPQEGESVR

FTTTADAFYMLLLEKPDGELVLESPVPWVEGDEVTVVGGSLNGTVVPSRQQDDGRVVLEISDEVANGDQFVWV

FKITY*

SEQ ID NO: 259
LENGTH: 3395 (including 150 bp 5' UTR and 150 bp 3' UTR)
TYPE: DNA
ORGANISM: M. phaseolina
AGCTAAACACGACTGAATACTCTCTTGCTTGAGCGAGTA -continued

```
GTTGGCACGTATGCTACGGCTCTGCTTGGCCATTGTGCTAAGAACTTGTACCGTAAATCTTGTATGTAAATGG
GAGGTAATCTCGGATTCGGCTCCTCTTACATTCTGAAGTGGGTATAGGGCGGACGCCTAACGCCCAGAACGGA
AGGAATTGCCTGGAAGCCGCGGAACACAACGACCCCCGCTCCTCGAAGACCTCGTAGGTGTATGTACATTTAC
TGCAGCGTTGGGAATCATCAATCGGAGTCTTAGAGCGGAAATGAATTATCAAATGGTTTTGCGACTGTCGAGC
TTGGCTGAGTCTGCGATAATGCACTTTCACCACCGTTGCGCCCGCTTCATCCCCGGCGAAGGATGCTTCTCAG
TCAGGGCTGAGATCAAGAGCCGCCAATATTCTACTCTCTATTGCAAGGAGCTCAGTCAAGCAGTCCACCACTT
GGCGGAGGCTGCGAAATGCATTCGCTCTCTGCGTCCCACATCCTCGGTTTGGTGCCGGTGGTGGCATAAGTCT
AGTGGTGCCAACGCGACTCCACGGTGACTCGATAGGCATATCATCGTCAGGCAAAGCTGCTGAGGTGTTGTCT
TGGGCCTCCTGAGCACTTGAGGTGGTAGGGTAGTAGTGTGCGGAATATCGGTGGAGTGCCAGGAGGAGAAGGA
CAGCGTCAATATGGCAACTCCGACCGATGAGGCGGAGATTTATGCTTCAATGTGTCGCAAAAAAATAATAAAT
AAAAAAATGCGAGGTTTTTTTTGACTGGTGCTCTCTCGCAATGGCGTCCGTTCCTTTTTGGGAGACTCGGCGA
CGTTTTGCAAGGTGGACTTGGTGTTATTCAGGTGAAGCGTTCATAACACGTGCGAGGAATAGGGTACAGCTGC
TGCGCCGCGGTATTCACAGAAGAAATGGTGCAGGCCGGCACCAGCTCGGGAAAGCGGATAGTCCGGGCGGCCT
CAATCAGCGTCTAGTGATGTGGAATGGTCGGGTTGTCTGGCGGGACAAAGCGCAAGTCACATGGATTTGAAGC
ATTCACCCGAAGGCAGATGTTAGGGAACTCCTGACACTCACGTCACCACTGATCACCCATGCTTTTAAAACAT
GCTAAAATTCGCCAAAAATTTTATAGACGCAGGTTGCATCGTGAAGGTGCAAGGGTTCCAATTGCGGGGTACG
AACTCCAAAAAAAAAAAAGGCACCCGCCACCATAGATTCGATAATATGCTGCTCGTGCTTTCGAATATGAAGT
CATTTAAGGTTTTGCGCTGTTTAACTCGCTCTTCACGTTACTGGTTGAACATTCAAGGCTGACACTGCCAGAC
AGAGGCTCCAGATCACAGTTCTGAGCCAACGCAAGCAACATATTTGTCGCAAGCAGTGTGACTCTTGCGCTGC
TGCTTCGAGCCGCGTCCACACTGAAGACTCCCAGGGAAATTCCATCTACGACTGGACCTTCATGGACCGCGTT
TTCGATTCCTACCTGTCCGCTAACGTAAAACCATATGTGCAAATTGGCTTTATGCCTCTGGCCTTATCAGCAG
GTCCAGATCCCAACTTCTTCACGTTCACGCCAACCTCGTCCTATGATGCCATCTACACCGGATGGTCCAGCCC
ACCCACCAACTATCAAACGTGGGAGGAATTGCTATATCAATGGACAAAGCACAACGTGGAGAAGTACGGGCAA
GCCGAAGTGGAGTCGTGGTACTGGGAAGTCTGGAACGAGCCCAACGTCGCCTACTGGAACGGCACGCGCGACG
AGTTCTGCGCACTGCACGACCACGCCATCGCCGCCGTCCGCCGCGCCCTCCCAACCGCACGAGTCGGAGGCTG
CGAAGCAGCCGGCGGAGCGGCGGAGCGGCTACCTCGCAGGGCTCCTGAGCCACAGCCTGCACGGTGGCAACTG
CGCCACCGGCGAGACAGGCACGCCGCGCTTCATCAAAGCCACGGCGCGAAGGAGGGTGGCTTCGTCCGGATGA
ACCTCTCCGCGCAGCTGCAGCAGATCGATGGGGCGTTCAGCGTCGGGGCGTCCTTCGCGGAGCTGCGCCAGAC
GCCCATCGTGATGGGCGAGTACATCCCGACGGGTGCGCGGCGTGCCAGACGCCGCAGTACGGGTACGAGAAC
GGCCCGCTGTATCAGTCCTATACGATTGCGACGTTTGTTCGCGCCTTGGATCTGGCGGACAGATGGGGCGTCA
ATCGGCAAGGGGCGCTGACCTGGGCGTTTGAGTACGAGGAGGCGGAGTTGTTTAATGATACGACATACTTTGA
TGGCTTCCGTGTGCTCGCGACGCAGGGTATTGACAAGCCGGTGCTCAACGCCCATCGAATGTTGGGGATGATG
ACAAGAGACAGGGTCTGGGCTGAGAGTGACGGTCAGGTGTCATTGGATGAAGCGGTGGCTGGGAGCGTCAGAG
GCAAGACCGATGTGGGTGTACTAGCTAGCGCCGACGAGGAGCGGGTGTATGTTCTGGTCTGGTATTACCATGA
CAACGACACCAGCTTCCAAGATGCGCAGGTAGATTTGACGATCGGAGGGCTGGAGAACAGAACATCTGCGAAC
CTGACGCATTTCCGCCTCGACGAGGAACACAGCAACTCTTATTCACTGTGGCGGCTTTACGCTCCCCAACAG
CCCCCACACCGGTGGATTATGAGCGTCTGGTAGCTGCAGGTAAACTTGAGAAACTAGAGACGTCAGGGAATGT
CAGCGTTGATGAGGATGGAAAGTATATCATGTCATTTGCCTTGCCAATACGATCTCTCTCATTAGTTGTGGTG
GAGCATGTTGAAGCAGGCAACAAGATTTCCTAATATCGTCCAACATTGGATCACAGTGAATGGCAAAAGACCA
TCCCCACTTTCCAATCCAATTTTCATGAAAAAAAAAAATAAAAAGAACAGAATAAAACAAATAATAAACCCCA
TTGCCATGAGCTGAATGGTTCATGGAGAGCCGAAGCA
```

SEQ ID NO: 260
LENGTH: 1491
TYPE: DNA
ORGANISM: M. phaseolina
FEATURE NAME/KEY: CDS
LOCATION: (1)...(1491)

```
atgaaccgaatcacagttctgagccaacgcaagcaacatatttgtcgcaagcagtgtgac
 M   N   R   I   T   V   L   S   Q   R   K   Q   H   I   C   R   K   Q   C   D tcttgcgctgctgcttcgagccgcgtccacactgaagactcccagggaaattccatctac
 S   C   A   A   A   S   S   R   V   H   T   E   D   S   Q   G   N   S   I   Y gactggaccttcatggaccgcgttttcgattcctacctgtccgctaacgtaaaaccatat
 D   W   T   F   M   D   R   V   F   D   S   Y   L   S   A   N   V   K   P   Y gtgcaaattggctttatgcctctggccttatcagcaggtccagatcccaacttcttcacg
 V   Q   I   G   F   M   P   L   A   L   S   A   G   P   D   P   N   F   F   T ttcacgccaacctcgtcctatgatgccatctacaccggatggtccagcccacccaccaac
 F   T   P   T   S   S   Y   D   A   I   Y   T   G   W   S   S   P   P   T   N tatcaaacgtgggaggaattgctatatcaatggacaaagcacaacgtggagaagtacggg
 Y   Q   T   W   E   E   L   L   Y   Q   W   T   K   H   N   V   E   K   Y   G caagccgaagtggagtcgtggtactgggaagtctggaacgagcccaacgtcgcctactgg
 Q   A   E   V   E   S   W   Y   W   E   V   W   N   E   P   N   V   A   Y   W aacggcacgcgcgacgagttctgcgcactgcacgaccacgccatcgccgccgtccgccgc
 N   G   T   R   D   E   F   C   A   L   H   D   H   A   I   A   A   V   R   R gccctcccaaccgcacgagtcggaggctgcgaagcagccggcggagcggcggagcggcta
 A   L   P   T   A   R   V   G   G   C   E   A   A   G   G   A   A   E   R   L cctcgcagggctcctgagccacagcctgcacggtggcaactgcgccaccggcgagacagg
 P   R   R   A   P   E   P   Q   P   A   R   W   Q   L   R   H   R   R   D   R cacgccgcgcttcatcaaagccacggcgcgaaggagggtggcttcgtccggatgaacctc
 H   A   A   L   H   Q   S   H   G   A   K   E   G   G   F   V   R   M   N   L tccgcgcagctgcagcagatcgatggggcgttcagcgtcggggcgtccttcgcggagctg
 S   A   Q   L   Q   Q   I   D   G   A   F   S   V   G   A   S   F   A   E   L cgccagacgcccatcgtgatgggcgagtacgatcccgacgggtgcgcggcgtgccagacg
 R   Q   T   P   I   V   M   G   E   Y   D   P   D   G   C   A   A   C   Q   T ccgcagtacgggtacgagaacggcccgctgtatcagtcctatacgattgcgacgtttgtt
 P   Q   Y   G   Y   E   N   G   P   L   Y   Q   S   Y   T   I   A   T   F   V cgcgccttggatctggcggacagatggggcgtcaatcggcaaggggcgctgacctgggcg
 R   A   L   D   L   A   D   R   W   G   V   N   R   Q   G   A   L   T   W   A tttgagtacgaggaggcggagttgtttaatgatacgacatactttgatggcttccgtgtg
 F   E   Y   E   E   A   E   L   F   N   D   T   T   Y   F   D   G   F   R   V ctcgcgacgcagggtattgacaagccggtgctcaacgcccatcgaatgttggggatgatg
 L   A   T   Q   G   I   D   K   P   V   L   N   A   H   R   M   L   G   M   M acaagagacagggtctgggctgagagtgacggtcaggtgtcattggatgaagcggtggct
 T   R   D   R   V   W   A   E   S   D   G   Q   V   S   L   D   E   A   V   A gggagcgtcagaggcaagaccgatgtgggtgtactagctagcgccgacgaggagcgggtg
 G   S   V   R   G   K   T   D   V   G   V   L   A   S   A   D   E   E   R   V tatgttctggtctggtattaccatgacaacgacaccagcttccaagatgcgcaggtagat
 Y   V   L   V   W   Y   Y   H   D   N   D   T   S   F   Q   D   A   Q   V   D ttgacgatcggagggctggagaacagaacatctgcgaacctgacgcatttccgcctcgac
 L   T   I   G   G   L   E   N   R   T   S   A   N   L   T   H   F   R   L   D gaggaacacagcaactcttattcactgtggcgggctttacgctcccaacagcccccaca
 E   E   H   S   N   S   Y   S   L   W   R   A   L   R   S   P   T   A   P   T ccggtggattatgagcgtctggtagctgcaggtaaacttgagaaactagagacgtcaggg
 P   V   D   Y   E   R   L   V   A   A   G   K   L   E   K   L   E   T   S   G aatgtcagcgttgatgaggatggaaagtatatcatgtcatttgccttgccaatacgatct
 N   V   S   V   D   E   D   G   K   Y   I   M   S   F   A   L   P   I   R   S ctctcattagttgtggtggagcatgttgaagcaggcaacaagatttcctaa
 L   S   L   V   V   V   E   H   V   E   A   G   N   K   I   S   -
         V   V   E   H   V   E   A   G   N   K   I   S   -
```

```
SEQ ID NO: 261
LENGTH: 496
TYPE: PRT
ORGANISM: M. phaseolina
MNRITVLSQRKQHICRKQCDSCAAASSRVHTEDSQGNSIYDWTFMDRVFDSYLSANVKPYVQIGFMPLALSAG

PDPNFFTFTPTSSYDAIYTGWSSPPTNYQTWEELLYQWTKHNVEKYGQAEVESWYWEVWNEPNVAYWNGTRDE

FCALHDHAIAAVRRALPTARVGGCEAAGGAAERLPRRAPEPQPARWQLRHRRDRHAALHQSHGAKEGGFVRMN

LSAQLQQIDGAFSVGASFAELRQTPIVMGEYDPDGCAACQTPQYGYENGPLYQSYTIATFVRALDLADRWGVN

RQGALTWAFEYEEAELFNDTTYFDGFRVLATQGIDKPVLNAHRMLGMMTRDRVWAESDGQVSLDEAVAGSVRG

KTDVGVLASADEERVYVLVWYYHDNDTSFQDAQVDLTIGGLENRTSANLTHFRLDEEHSNSYSLWRALRSPTA

PTPVDYERLVAAGKLEKLETSGNVSVDEDGKYIMSFALPIRSLSLVVVEHVEAGNKIS*

SEQ ID NO: 262
LENGTH: 1848 (including 150 bp 5' UTR and 150 bp 3' UTR)
TYPE: DNA
ORGANISM: M. phaseolina
CGTGCGTCTTGGCTCCGCGTATATATAGAGAGAGCCCAGCAGGTCGAGTTTAGTTCCTTTTTGTTGTTTTTTT

GCCTCGCAAAGTAAGCTTATCTCCTTCCCGCCCGCCACACCCGCACCACAATGCCGCCTCGCGGCCTCAGGCA

CAACATGAAGGCGGCACTTGTCCTCCTCTGCAGCGCTGTCACGACCACCACCATGGCCGACTTCACCAACCCG

GTGCTCTGGGAGGACCTGGCCGACCTGGACATTTTCCGGGTAGACGACACCTTCTACTACTCAGCCTCGACAA

TGGCGTACTCGCCGGGCGCGCCAATCCTGCGGTCCTACGACCTCGCCAACTGGGAGTTCGTGGGGCACAGCGT

GCCGGTGCTCGACTTCGGGGACGCGTACGACCTCAACGGCGGGCAAGCTTACGTGCAAGGGATCTGGGCGAGC

TTCTGCAACTACCGGCCGTCGAACAAGCTGTTCTACTGGGGCGGCTGCATCCGGTCCGATCTCAAGACGCACA

TCTACACGGCATCCGACGTGGCAGGCGAGTGGAGCAAGCACGCCGTCATCGACACGTGCTACTACGACGCCGG

GCTGCTGGTCGACACAGATGACACGCTGTACGTCGCCCATGGCAACACCAACATCTCCGTCGCGCAGCTGTCG

GCCGACGGCACGGGCGAGGTCAGCACGCAGGTCGTGTACGAGTCGCCCATCTACATCGAAGGGTCGCGCTTCT

ACAACATCAACGGCACCTACTACATCTTCCTGACGCGCCCGCCCGATGCCGAGTTCGTGCTCAAGTCGACCAA

CGGCCCCCTCGGTCCGTACGAGGGCCGCTACCTCGTCGACCGGGTTGCCGCGCCGGTCGACGGGGCCGGGGCA

CCGCACCAGGGCGGCATTGTCGATACGCCCGGCGGCGACTGGTACTACATGTCCTTCATCGACGCGTACCCGG

GCGGGCGCATGCCGGTGCTGGCGCCCATCACCTGGGACGATGACGGCTGGCCGTCCGTCACGCTCGATGCCAA

CGGCGGCTGGGCCGCGACCTACCCGTCGCCCGGCGTGCCCACGCCGCCGCGCGAAGTCGAGTCGCCGGTTGGT

GTCGACGAATTCTCCGGCACGGCCTTGAGCCACCAGTGGGAGTGGAACCACAACCCGGACAACACCAAGTGGT

CGCTCGATGGCGGCTTGCGGCTGCAGACGGCCACTGTGACGGACGACCTGTACGCAGCGCGGAATACGCTGAC

GCACAGGATCGTCGGACCCAAGTCGGCAGGCACCATTGTACTGGATTACTCGTCCATGGCAGATGGAGACCGC

GCCGGTCTCTCGCTCTTCCGTGACCAGTCGGCCTGGATCGGCATCATCAAGGATGCCGGGGCTACCAAGATCG

CGGTGTGGGACGACATTACCATGGATTCGAGCTGGAACACCAACAGCACAGGATCCGAAGTGGCGAGCGCAGA

CATCTCTGGAAGCAGGGTCTGGCTGAGGGTTGATGCTGACATCGCGCCTGCTGGCACCAAGCAAGGCGTCTTC

TCGTACAGCACCGACGGGACGACCTTTACCAACCTGGGGTCCGCGTTCACCATGAACACGGCGTGGCAGTATT

TCATCGGCTACCGCTTTGGCATCTTCAACTTCGCTACGCAAGCACTTGGAGGGTCGGTCCTGGTAGAGTCGTT

TGAAATGCAGCTTTCGTAGGACATAGGCGCTGAAATAGATATCTGAATGGATTCCTCAAACCTACCTTGTA

CACAGCGGGCCGTCGGACGTCACTCAGTCCTGAATGTCCTCGCCGTCGCCGATCATGTGCTTGAAATCGCCTA

GGATAGTGTTCCACGAGTCCTCC
```

SEQ ID NO: 263
LENGTH: 1548
TYPE: DNA
ORGANISM: M. phaseolina
FEATURE NAME/KEY: CDS
LOCATION: (1)...(1548)

```
atgaaggcggcacttgtcctcctctgcagcgctgtcacgaccaccaccatggccgacttc
 M  K  A  A  L  V  L  L  C  S  A  V  T  T  T  T  M  A  D  F accaacccggtgctctgggaggacctggccgacctggacatttccgggtagacgacacc
 T  N  P  V  L  W  E  D  L  A  D  L  D  I  F  R  V  D  D  T ttctactactcagcctcgacaatggcgtactcgccgggcgcgccaatcctgcggtcctac
 F  Y  Y  S  A  S  T  M  A  Y  S  P  G  A  P  I  L  R  S  Y gacctcgccaactgggagttcgtggggcacagcgtgccggtgctcgacttcggggacgcg
 D  L  A  N  W  E  F  V  G  H  S  V  P  V  L  D  F  G  D  A tacgacctcaacggcgggcaagcttacgtgcaagggatctgggcgagcttctgcaactac
 Y  D  L  N  G  G  Q  A  Y  V  Q  G  I  W  A  S  F  C  N  Y cggccgtcgaacaagctgttctactggggcggctgcatccggtccgatctcaagacgcac
 R  P  S  N  K  L  F  Y  W  G  G  C  I  R  S  D  L  K  T  H atctacacggcatccgacgtggcaggcgagtggagcaagcacgccgtcatcgacacgtgc
 I  Y  T  A  S  D  V  A  G  E  W  S  K  H  A  V  I  D  T  C tactacgacgccgggctgctggtcgacacagatgacacgctgtacgtcgcccatggcaac
 Y  Y  D  A  G  L  L  V  D  T  D  D  T  L  Y  V  A  H  G  N accaacatctccgtcgcgcagctgtcggccgacggcacgggcgaggtcagcacgcaggtc
 T  N  I  S  V  A  Q  L  S  A  D  G  T  G  E  V  S  T  Q  V gtgtacgagtcgcccatctacatcgaagggtcgcgcttctacaacatcaacggcacctac
 V  Y  E  S  P  I  Y  I  E  G  S  R  F  Y  N  I  N  G  T  Y tacatcttcctgacgcgcccgcccgatgccgagttcgtgctcaagtcgaccaacggcccc
 Y  I  F  L  T  R  P  P  D  A  E  F  V  L  K  S  T  N  G  P ctcggtccgtacgagggccgctacctcgtcgaccgggttgccgcgccggtcgacggggcc
 L  G  P  Y  E  G  R  Y  L  V  D  R  V  A  A  P  V  D  G  A ggggcaccgcaccagggcggcattgtcgatacgcccggcggcgactggtactacatgtcc
 G  A  P  H  Q  G  G  I  V  D  T  P  G  G  D  W  Y  Y  M  S ttcatcgacgcgtacccgggcgggcgcatgccggtgctggcgcccatcacctgggacgat
 F  I  D  A  Y  P  G  G  R  M  P  V  L  A  P  I  T  W  D  D gacggctggccgtccgtcacgctcgatgccaacggcggctgggccgcgacctacccgtcg
 D  G  W  P  S  V  T  L  D  A  N  G  G  W  A  A  T  Y  P  S cccggcgtgcccacgccgccgcgcgaagtcgagtcgccggttggtgtcgacgaattctcc
 P  G  V  P  T  P  P  R  E  V  E  S  P  V  G  V  D  E  F  S ggcacggccttgagccaccagtgggagtggaaccacaacccggacaacaccaagtggtcg
 G  T  A  L  S  H  Q  W  E  W  N  H  N  P  D  N  T  K  W  S ctcgatggcggcttgcggctgcagacggccactgtgacggacgacctgtacgcagcgcgg
 L  D  G  G  L  R  L  Q  T  A  T  V  T  D  D  L  Y  A  A  R aatacgctgacgcacaggatcgtcggacccaagtcggcaggcaccattgtactggattac
 N  T  L  T  H  R  I  V  G  P  K  S  A  G  T  I  V  L  D  Y tcgtccatggcagatggagaccgcgccggtctctcgctcttccgtgaccagtcggcctgg
 S  S  M  A  D  G  D  R  A  G  L  S  L  F  R  D  Q  S  A  W atcggcatcatcaaggatgccggggctaccaagatcgccggtgtgggacgacattaccatg
 I  G  I  I  K  D  A  G  A  T  K  I  A  V  W  D  D  I  T  M gattcgagctggaacaccaacagcacaggatccgaagtggcgagcgcagacatctctgga
 D  S  S  W  N  T  N  S  T  G  S  E  V  A  S  A  D  I  S  G agcagggtctggctgagggttgatgctgacatcgcgcctgctggcaccaagcaaggcgtc
 S  R  V  W  L  R  V  D  A  D  I  A  P  A  G  T  K  Q  G  V ttctcgtacagcaccgacgggacgacctttaccaacctggggtccgcgttcaccatgaac
 F  S  Y  S  T  D  G  T  T  F  T  N  L  G  S  A  F  T  M  N
```

```
acggcgtggcagtatttcatcggctaccgctttggcatcttcaacttcgctacgcaagca
 T   A   W   Q   Y   F   I   G   Y   R   F   G   I   F   N   F   A   T   Q   A cttggagggtcggtcctggtagagtcgtttgaaatgcagctttcgtag
 L   G   G   S   V   L   V   E   S   F   E   M   Q   L   S   -
```

SEQ ID NO: 264
LENGTH: 515
TYPE: PRT
ORGANISM: *M. phaseolina*
MKAALVLLCSAVTTTTMADFTNPVLWEDLADLDIFRVDDTFYYSASTMAYSPGAPILRSYDLANWEFVGHSVP

VLDFGDAYDLNGGQAYVQGIWASFCNYRPSNKLFYWGGCIRSDLKTHIYTASDVAGEWSKHAVIDTCYYDAGL

LVDTDDTLYVAHGNTNISVAQLSADGTGEVSTQVVYESPIYIEGSRFYNINGTYYIFLTRPPDAEFVLKSTNG

PLGPYEGRYLVDRVAAPVDGAGAPHQGGIVDTPGGDWYYMSFIDAYPGGRMPVLAPITWDDDGWPSVTLDANG

GWAATYPSPGVPTPPREVESPVGVDEFSGTALSHQWEWNHNPDNTKWSLDGGLRLQTATVTDDLYAARNTLTH

RIVGPKSAGTIVLDYSSMADGDRAGLSLFRDQSAWIGIIKDAGATKIAVWDDITMDSSWNTNSTGSEVASADI

SGSRVWLRVDADIAPAGTKQGVFSYSTDGTTFTNLGSAFTMNTAWQYFIGYRFGIFNFATQALGGSVLVESFE

MQLS*

SEQ ID NO: 265
LENGTH: 1860 (including 150 bp 5' UTR and 150 bp 3' UTR)
TYPE: DNA
ORGANISM: *M. phaseolina*
GCGCCACCGGCCCGCCCGGCCAGCGGCTCAAGGGCCGATATTCCTGCTTGCACGATGTTGATTTCACCCCAGG

CTTGATATAATTGCAACCTTCCGTCGATTGTGGCCTTCCACAACCTGGATCATTCACTCGCTCAGGACCTCTT

CGTCATGAAGCCTGCCATCGTTCTCGCGGCTATTCTGCCCATATCCTGGGCGGCAGGCGCGACTTTCTCCAAT

CCGGTCGTGTACGAGGATTTCGCTGACAATGACGTCTCGGTTGGACCGGATGGTCTCTTCTACTTCTCCGCAT

CGAATATGCACTATAGTCCTGGCGCACCTATCCTACGATCGTACGATCTTGCCAATTGGGAGCTCATCGGCCA

TTCTGTGCCGAGCCTGGATTTTGGAGAGCGGTACAACCTGACCGGCGGCCAGGCCTACAGGGGTGGCACTTGG

GCGTCCACGATGCGGTACCGTGAAAGCAATGGCCTATGGTACTGGATTGGATGCGTCGACTTCTGGTACACGT

ATATCTACACCAGCAAGTCCCCAACGGGTCCCTGGACCAGGTCTGCCCAGCTACCTGGTGGCACCTGCTACTA

CGACTGCGGCCTCTTAGTGGATGACGACGACACGATGTATGTCGTCTATGGAGCTACGGACGTCAAGGTTGCT

CAGCTTGCTGCCGACGGACTGAGTGAAGTGAAGAGCCAGGGAGTCTTCAGTGCTTCGGACGTGGGACAGGACG

GCATCGAGGGGAACCGCATGTACAAGCGCAACGGCAACTACTACATCCTCAACGATCACCCCGGCGACAACAC

CTACATCTGGAAGTCATCGAGCCCATGGGGCCCATACGCCAGCAAGATACTCGTCCAGAACATCCAGTCCCCC

GTCTCCGGCGGCGGTGCCCCCCACCAGGGCAGTCTCGTCAAGACAGCCGACGATGACTGGTACTATATGTCCT

TCACGTGGGCCTACCCAGCCGGCCGCATGCCCGTCCTCGGCCCCGTCACCTGGGGCAGCGATGATTTCCCCGT

CTTTGTCGACGGGTCCAACGGCGGGTGGGGCGTTTCATACCCACTCCCGCTGCCTGCGCACCCGCTCCCGAGC

TGGACGGGCACTGACGCGTTCCGAGGCACCTCCCTGGGCCCCGCGTGGGAGTGGAACCATAATCCGGACCCGT

CCAAGTACGCCGTCAACAATGGCCTGACCCTCTCAGCTGCCACGGTCACGGACGATCTGTACGCCGCGCGCAA

CACCCTGACGCACCGCATCCACGGCGAGTTCCCCGTCGGGACCGTGGCCATCGACTTCTCGAACCTCGCTGAC

GGCGACCGTGCCGGTCTGGCTGCTTTCCGGGACCGCAGCGCCTCGATCGGCGTCCACCGCGACGGCGACACGT

ACACCATCCAGGTCGTGCACGGCATGACGCAGGACGAGTCGACGTGGGCGACAACGAGCAAGGGGACCACAGT

GGCCACGGCGCCGGTGCCCGGCGGGGCAAAGAAGGTGTGGTTGCGGGCGGCGCTGGATGCGCGCGCGAGCGGG

ACGAAGGCGGCGAACTTCTCCTACAGCTTCGATGGGGACGAGTTCGAGCAGCTGGGGCGGCCGTATACGATGT

GGACGAACTGGGCGTATTTCATGGGGTATCGGTTCGGCATCTTCAACTATGCCACCAAGAAACTTGGCGGCTC

CGTCGCGGTCTCTTCGTTTAGTAGTGCATAGTTTCTGTGAGGGTGCGTGGGAGCTCCGTTGGGGAAGCTCTCT

CATCTATTAGGGTTGGATTCGCTCATCATAATGCAAGAGAAATATATAAACATTAAGACGATCCAGGCTCAAC

GATGGCCGGTATTACATGGAGCAGAGAGCAATGCG

SEQ ID NO: 266
LENGTH: 1560
TYPE: DNA
ORGANISM: M. phaseolina
FEATURE NAME/KEY: CDS
LOCATION: (1)...(1560)

```
atgaagcctgccatcgttctcgcggctattctgcccatatcctgggcggcaggcgcgact
 M   K   P   A   I   V   L   A   A   I   L   P   I   S   W   A   A   G   A   T ttctccaatccggtcgtgtacgaggatttcgctgacaatgacgtctcggttggaccggat
 F   S   N   P   V   V   Y   E   D   F   A   D   N   D   V   S   V   G   P   D ggtctcttctacttctccgcatcgaatatgcactatagtcctggcgcacctatcctacga
 G   L   F   Y   F   S   A   S   N   M   H   Y   S   P   G   A   P   I   L   R tcgtacgatcttgccaattgggagctcatcggccattctgtgccgagcctggattttgga
 S   Y   D   L   A   N   W   E   L   I   G   H   S   V   P   S   L   D   F   G gagcggtacaacctgaccggcggccaggcctacaggggtggcacttgggcgtccacgatg
 E   R   Y   N   L   T   G   G   Q   A   Y   R   G   G   T   W   A   S   T   M cggtaccgtgaaagcaatggcctatggtactggattggatgcgtcgacttctggtacacg
 R   Y   R   E   S   N   G   L   W   Y   W   I   G   C   V   D   F   W   Y   T tatatctacaccagcaagtccccaacgggtcctggaccaggtctgcccagctacctggt
 Y   I   Y   T   S   K   S   P   T   G   P   W   T   R   S   A   Q   L   P   G ggcacctgctactacgactgcggcctcttagtggatgacgacgacacgatgtatgtcgtc
 G   T   C   Y   Y   D   C   G   L   L   V   D   D   D   D   T   M   Y   V   V tatggagctacggacgtcaaggttgctcagcttgctgccgacggactgagtgaagtgaag
 Y   G   A   T   D   V   K   V   A   Q   L   A   A   D   G   L   S   E   V   K agccagggagtcttcagtgcttcggacgtgggacaggacggcatcgaggggaaccgcatg
 S   Q   G   V   F   S   A   S   D   V   G   Q   D   G   I   E   G   N   R   M tacaagcgcaacggcaactactacatcctcaacgatcaccccggcgacaacacctacatc
 Y   K   R   N   G   N   Y   Y   I   L   N   D   H   P   G   D   N   T   Y   I tggaagtcatcgagcccatggggcccatacgccagcaagatactcgtccagaacatccag
 W   K   S   S   S   P   W   G   P   Y   A   S   K   I   L   V   Q   N   I   Q tcccccgtctccggcggcggtgcccccaccagggcagtctcgtcaagacagccgacgat
 S   P   V   S   G   G   G   A   P   H   Q   G   S   L   V   K   T   A   D   D gactggtactatatgtccttcacgtgggcctacccagccggccgcatgcccgtcctcggc
 D   W   Y   Y   M   S   F   T   W   A   Y   P   A   G   R   M   P   V   L   G cccgtcacctggggcagcgatgatttccccgtctttgtcgacgggtccaacggcggtgg
 P   V   T   W   G   S   D   D   F   P   V   F   V   D   G   S   N   G   G   W ggcgtttcatacccactcccgctgcctgcgcacccgctcccgagctggacgggcactgac
 G   V   S   Y   P   L   P   L   P   A   H   P   L   P   S   W   T   G   T   D gcgttccgaggcacctccctgggcccgcgtgggagtggaaccataatccggacccgtcc
 A   F   R   G   T   S   L   G   P   A   W   E   W   N   H   N   P   D   P   S aagtacgccgtcaacaatggcctgaccctctcagctgccacggtcacggacgatctgtac
 K   Y   A   V   N   N   G   L   T   L   S   A   A   T   V   T   D   D   L   Y gccgcgcgcaacaccctgacgcaccgcatccacggcgagttccccgtcgggaccgtggcc
 A   A   R   N   T   L   T   H   R   I   H   G   E   F   P   V   G   T   V   A atcgacttctcgaacctcgctgacggcgaccgtgccggtctggctgctttccgggaccgc
 I   D   F   S   N   L   A   D   G   D   R   A   G   L   A   A   F   R   D   R agcgcctcgatcggcgtccaccgcgacggcgacacgtacaccatccaggtcgtgcacggc
 S   A   S   I   G   V   H   R   D   G   D   T   Y   T   I   Q   V   V   H   G atgacgcaggacgagtcgacgtgggcgacaacgagcaaggggaccacagtggccacggcg
 M   T   Q   D   E   S   T   W   A   T   T   S   K   G   T   T   V   A   T   A ccggtgcccggcggggcaaagaaggtgtggttgcgggcggcgctggatgcgcgcgcgagc
 P   V   P   G   G   A   K   K   V   W   L   R   A   A   L   D   A   R   A   S gggacgaaggcggcgaacttctcctacagcttcgatggggacgagttcgagcagctgggg
 G   T   K   A   A   N   F   S   Y   S   F   D   G   D   E   F   E   Q   L   G
```

```
-continued
cggccgtatacgatgtggacgaactgggcgtatttcatggggtatcggttcggcatcttc
 R  P  Y  T  M  W  T  N  W  A  Y  F  M  G  Y  R  F  G  I  F aactatgccaccaagaaacttggcggctccgtcgcggtctcttcgtttagtagtgcatag
 N  Y  A  T  K  K  L  G  G  S  V  A  V  S  S  F  S  S  A  -
```

SEQ ID NO: 267
LENGTH: 519
TYPE: PRT
ORGANISM: *M. phaseolina*
MKPAIVLAAILPISWAAGATFSNPVVYEDFADNDVSVGPDGLEYESASNMHYSPGAPILRSYDLANWELIGHS

VPSLDFGERYNLTGGQAYRGGTWASTMRYRESNGLWYWIGCVDFWYTYIYTSKSPTGPWTRSAQLPGGTCYYD

CGLLVDDDDTMYVVYGATDVKVAQLAADGLSEVKSQGVESASDVGQDGIEGNRMYKRNGNYYILNDHPGDNTY

IWKSSSPWGPYASKILVQNIQSPVSGGGAPHQGSLVKTADDDWYYMSFTWAYPAGRMPVLGPVTWGSDDEPVF

VDGSNGGWGVSYPLPLPAHPLPSWTGTDAFRGTSLGPAWEWNHNPDPSKYAVNNGLTLSAATVTDDLYAARNT

LTHRIHGEFPVGTVAIDFSNLADGDRAGLAAFRDRSASIGVHRDGDTYTIQVVHGMTQDESTWATTSKGTTVA

TAPVPGGAKKVWLRAALDARASGTKAANFSYSEDGDEFEQLGRPYTMWTNWAYFMGYREGIFNYATKKLGGSV

AVSSFSSA*

SEQ ID NO: 268
LENGTH: 3042 (including 150 bp 5' UTR and 150 bp 3' UTR)
TYPE: DNA
ORGANISM: *M. phaseolina*
CTTCCTTGCGGAGAACAGGACTGATCCCGCCGGTTCCTGCGTCCCAGCCGCCCATGCCACCACTCGCTCGGTG

CTATTTAAGCAGCCGCACGCGGCTCGACATTGCTGCTCGCTCACGCCCTTCTCCCAACACTCCATCCTCCCCT

AGCCATGCCGTTGCGCACAGGCATTGCAGGCGTTGCCGCTTTGGCCGCCCAGGCTTCTGCTGTGAGCCTTACG

GCCTTCGGCTTTCCCGACTGCGTCAATGGGCCCTTGAAAGACAACTTGGTCTGCGACAGCTCTGCCAGTGCGT

GCTATTTCTCATGCGCTACTCCGTCTGCTCTCCCTGGAAACTGACTATACTACCGTAGCTCCCCTTGCCAGAG

CAACCGCCCTGGTCAAGGAGCTTACGCTCGAGGAGAAGCTCAACAACACTGGCAACACCAGCCCCGGTGTTCC

CCGCCTTGGCATCCCCGAGTAcCAGTGGTGGAACGAAGGTCTGTAACGTCGTATTATCTCAGCGTGACAGATC

GATGCTGACCACTCGGCCACAGCACTACACGGCGTGGCATTCACCTACCCAGGGCAGCCAATGACTGAATCGG

GCAATTTTTCCAGCGCCACCTCTTTTCCCCAACCCATCCTGATGGGCGCAGCCTTTGACGATGAATTGATCTA

CGAAGTTGCCAGCGTCGTGAGCACTGAGGCAAGAGCATATAGCAACGGCGGCCGGTCTGGCTTGGATTACTGG

GTAAGTCGTGTAAGACCCTGTCGAGTTCGCAGACAGGCTATACCGCCAACAACTCCTCCACCCGCTGCAAGTC

TCGAGTGACACTAACGACATGCTACACAGACACCGAACATCAATCCATACAAAGACCCAAGATGGGGCCGCGG

TCAGGGTGAGTACTTACTGGTGTTACTTGAGTGACGAAAATATCGATACGCTGACAACTTATACAGAAACGCC

CGGAGAGGATCCCTTCCATCTCGCTAGCTACGTCCAGAACTTGATTCGTGGTCTGGAGGGaAACCAAAATGAC

CCGTACAAGAAGATCGTAGCCACGTGCAAGCATTTCACCGGCTACGATATGGAAAACTGGAATGGTAATTTTA

GGTACCAATTCGATGCCCAGATCAACATGAGAGACATGGTGGAGTATTATATGCCCCCATTCCAGGCATGTGC

GAGGGAAGCAAAGGTCGGTGCCTTCATGTGCTCGTACAATGCTGTAAACGGAGTGCCCACTTGTGCGGACCCG

TGGCTGCTTCAGACCGTACTTCGCGAGCACTGGGGCTGGAACCAGGAAGATCAATGGGTCGTCAGCGATTGCG

ATGCTATCCAGAACGTCTATCTGCCTCATGAGTGGGCCGAGTCCCGCGAGCAGGCTGTTGCAGACACCTTGAA

TGCTGGCACAGGTATACAGCTTTTCATACTCCCTATACCTTCGGCATTGGCTGATTTCTCATTTAGATCTCAA

CTGTGGGACCTACTACCAGAGATACTTGCCTGGGGCTTACGAGCAGGGGCTCATCAACGACACGACTCTTGAT

AGGGCTCTGACTCGGACTTACTCCTCCCTGATCAAGCTAGGCTATTTTGACAATGCCGACTCGCAACCATACC

GCCAGATTGGCTGGCAAGACGTGAACTCGCAGCACGCGCAGGAGCTCGCCCTCAAAGCTGCCCAAGAAGGCAT

CGTGCTTCTTAAGAATGATGGCCTTCTTCCTCTGTCTCTCGACGGTGTCTCCTCCATCGCTCTGATTGGCTCG

TGGGCCAACGCCACGGAGCAGATGCAAGGCAACTATGCTGGAGTAGCGCCTTATCTCCATTCTCCGCTGTATG

CGGCCGAGCAGCTCGGCGTCAAGGTCAACTACGCAGAGGGTGCTTCTCAAAGCAACCCCACAACAGATCAGTG

-continued

```
GGGCGCGGAGTACACCGCTGCAGAGAACTCGGACGTCATCATCGTCGTCGGCGGCATCGACAACGACATCGAA
AGCGAGGAACTTGACCGCGTAGCCATCGCCTGGTCAGGTCCGCAGCTGGACATGATCACCAAGCTGGCAACAT
ACGGCAAGCCCGTCATCGTCGTGCAGATGGGCGCAGGCCAGCTCGACAGCACGCCGCTCGTCTCCAACGCCAA
CATCTCCGCCCTCCTTTGGGGCGGTTACCGGGCCAAGACGGCGGCACCGCGCTCTTTGACATCATCACCGGC
GCCGTGGCGCCCGCCGGCCGCCTGCCCATCACCCAGTACCCCGCGCGCTACACCAAGGAGGTCGCAATGACGG
ACATGTCTTTGCGGCCGTCCTCCACCAGCGCCGGCCGACACCTACAAGTGGTACAACGGCACTGCCGTCTTCCC
CTTCGGCTTCGGCCTCCACTACACCAACTTCAGTGCCGCCATACCTTCCCCTCCCGCCTCATCCTTCGCCATC
TCCGACCTCGTCGCCTCGTGCAGCGCCAATGACACCTCCAAACTCGACCTCTGCCCCTTCACCTCCCTCGCCG
TCGACATTGCCAACGACGGCACCCGCGCCTCTGACTTCGTCGCCCTCGCCTTCTTGACCGGCGAGTTCGGCCC
GTCCCCGCACCCCAAATCCAGCCTCGTTGCCTACCAGCGCTTGCACGCCATCGCCGCGGGCGAAACGCAGACC
GCGCGCCTCAACCTCACTCTTGGCAGCTTGGTGCGTGTGGATGAAAATGGAGACAAGCTGCTGTATCCCGGCG
ACTATAGCGTTTTGATTGACGTGCCGGACAAGCCTCTGGCGAGCGTCAATTTCACGCTGACAGGCGATGAGGC
TGGCACTGTGATTGAGCGTTGGCCGAGGCTGAACGCGGATAGGAAGGGGGCTGGAGTGGAGAATGTGCCGGCG
GATTATTATGAAGGTGGGTTTGGGAGTGAGCAGGAGGTGTTGTAAGGGGAAGAATTGTGGCTCGTGCGTCGTC
TGAGAGGAGGTGGGCAGTGACCCTGCGTCCAATGTATAATGTAGAACTTCCTAATGTACGCAATGATTGCGAG
TCACCAAAAGCTCGCTATGTATTGACACAGATGAATGTAAACGGCCGCG
```

SEQ ID NO: 269  
LENGTH: 2403  
TYPE: DNA  
ORGANISM: *M. phaseolina*  
FEATURE NAME/KEY: CDS  
LOCATION: (1)...(2403)

```
atgccgttgcgcacaggcattgcaggcgttgccgctttggccgcccaggcttctgctgtg
 M   P   L   R   T   G   I   A   G   V   A   A   L   A   A   Q   A   S   A   V agccttacggccttcggctttcccgactgcgtcaatgggcccttgaaagacaacttggtc
 S   L   T   A   F   G   F   P   D   C   V   N   G   P   L   K   D   N   L   V tgcgacagctctgccactccccttgccagagcaaccgccctggtcaaggagcttacgctc
 C   D   S   S   A   T   P   L   A   R   A   T   A   L   V   K   E   L   T   L gaggagaagctcaacaacactggcaacaccagccccggtgttccccgccttggcatcccc
 E   E   K   L   N   N   T   G   N   T   S   P   G   V   P   R   L   G   I   P gagtaccagtggtggaacgaagcactacacggcgtggcattcacctacccagggcagcca
 E   Y   Q   W   W   N   E   A   L   H   G   V   A   F   T   Y   P   G   Q   P atgactgaatcgggcaattttccagcgccacctcttttccccaacccatcctgatgggc
 M   T   E   S   G   N   F   S   S   A   T   S   F   P   Q   P   I   L   M   G gcagcctttgacgatgaattgatctacgaagttgccagcgtcgtgagcactgaggcaaga
 A   A   F   D   D   E   L   I   Y   E   V   A   S   V   V   S   T   E   A   R gcatatagcaacggcggccggtctggcttggattactggacaccgaacatcaatccatac
 A   Y   S   N   G   G   R   S   G   L   D   Y   W   T   P   N   I   N   P   Y aaagacccaagatggggccgcggtcaggaaacgcccggagaggatcccttccatctcgct
 K   D   P   R   W   G   R   G   Q   E   T   P   G   E   D   P   F   H   L   A agctacgtccagaacttgattcgtggtctggagggaaaccaaaatgacccgtacaagaag
 S   Y   V   Q   N   L   I   R   G   L   E   G   N   Q   N   D   P   Y   K   K atcgtagccacgtgcaagcatttcaccggctacgatatggaaaactggaatggtaattt
 I   V   A   T   C   K   H   F   T   G   Y   D   M   E   N   W   N   G   N   F aggtaccaattcgatgcccagatcaacatgagagacatggtggagtattatgcccca
 R   Y   Q   F   D   A   Q   I   N   M   R   D   M   V   E   Y   Y   M   P   P ttccaggcatgtgcgagggaagcaaaggtcggtgccttcatgtgctcgtacaatgctgta
 F   Q   A   C   A   R   E   A   K   V   G   A   F   M   C   S   Y   N   A   V aacggagtgccccacttgtgcggacccgtggctgcttcagaccgtacttcgcgagcactgg
 N   G   V   P   T   C   A   D   P   W   L   L   Q   T   V   L   R   E   H   W
```

-continued

```
ggctggaaccaggaagatcaatgggtcgtcagcgattgcgatgctatccagaacgtctat
 G  W  N  Q  E  D  Q  W  V  V  S  D  C  D  A  I  Q  N  V  Y ctgcctcatgagtgggccgagtcccgcgagcaggctgttgcagacaccttgaatgctggc
 L  P  H  E  W  A  E  S  R  E  Q  A  V  A  D  T  L  N  A  G acagatctcaactgtgggacctactaccagagatacttgcctggggcttacgagcagggg
 T  D  L  N  C  G  T  Y  Y  Q  R  Y  L  P  G  A  Y  E  Q  G ctcatcaacgacacgactcttgatagggctctgactcggacttactcctccctgatcaag
 L  I  N  D  T  T  L  D  R  A  L  T  R  T  Y  S  S  L  I  K ctaggctattttgacaatgccgactcgcaaccataccgccagattggctggcaagacgtg
 L  G  Y  F  D  N  A  D  S  Q  P  Y  R  Q  I  G  W  Q  D  V aactcgcagcacgcgcaggagctcgccctcaaagctgcccaagaaggcatcgtgcttctt
 N  S  Q  H  A  Q  E  L  A  L  K  A  A  Q  E  G  I  V  L  L aagaatgatggccttcttcctctgtctctcgacggtgtctcctccatcgctctgattggc
 K  N  D  G  L  L  P  L  S  L  D  G  V  S  S  I  A  L  I  G tcgtgggccaacgccacggagcagatgcaaggcaactatgctggagtagcgccttatctc
 S  W  A  N  A  T  E  Q  M  Q  G  N  Y  A  G  V  A  P  Y  L cattctccgctgtatgcggccgagcagctcggcgtcaaggtcaactacgcagagggtgct
 H  S  P  L  Y  A  A  E  Q  L  G  V  K  V  N  Y  A  E  G  A tctcaaagcaaccccacaacagatcagtggggcgcggagtacaccgctgcagagaactcg
 S  Q  S  N  P  T  T  D  Q  W  G  A  E  Y  T  A  A  E  N  S gacgtcatcatcgtcgtcggcggcatcgacaacgacatcgaaagcgaggaacttgaccgc
 D  V  I  I  V  V  G  G  I  D  N  D  I  E  S  E  E  L  D  R gtagccatcgcctggtcaggtccgcagctggacatgatcaccaagctggcaacatacggc
 V  A  I  A  W  S  G  P  Q  L  D  M  I  T  K  L  A  T  Y  G aagcccgtcatcgtcgtgcagatgggcgcaggccagctcgacagcacgccgctcgtctcc
 K  P  V  I  V  V  Q  M  G  A  G  Q  L  D  S  T  P  L  V  S aacgccaacatctccgccctcctttggggcggttacccgggccaagacggcggcaccgcg
 N  A  N  I  S  A  L  L  W  G  G  Y  P  G  Q  D  G  G  T  A ctctttgacatcatcaccggcgccgtggcgcccgccggccgcctgcccatcacccagtac
 L  F  D  I  I  T  G  A  V  A  P  A  G  R  L  P  I  T  Q  Y cccgcgcgctacaccaaggaggtcgcaatgacggacatgtctttgcggccgtcctccacc
 P  A  R  Y  T  K  E  V  A  M  T  D  M  S  L  R  P  S  S  T agcgccggccgcacctacaagtggtacaacggcactgccgtcttcccctttcggcttcggc
 S  A  G  R  T  Y  K  W  Y  N  G  T  A  V  F  P  F  G  F  G ctccactacaccaacttcagtgccgccataccttcccctcccgcctcatccttcgccatc
 L  H  Y  T  N  F  S  A  A  I  P  S  P  P  A  S  S  F  A  I tccgacctcgtcgcctcgtgcagcgccaatgacacctccaaactcgacctctgccccttc
 S  D  L  V  S  S  C  S  A  N  D  T  S  K  L  D  L  C  P  F acctccctcgccgtcgacattgccaacgacggcacccgcgcctctgacttcgtcgccctc
 T  S  L  A  V  D  I  A  N  D  G  T  R  A  S  D  F  V  A  L gccttcttgaccggcgagttcggcccgtccccgcaccccaaatccagcctcgttgcctac
 A  F  L  T  G  E  F  G  P  S  P  H  P  K  S  S  L  V  A  Y cagcgcttgcacgccatcgccgcgggcgaaacgcagaccgcgcgcctcaacctcactctt
 Q  R  L  H  A  I  A  A  G  E  T  Q  T  A  R  L  N  L  T  L ggcagcttggtgcgtgtggatgaaaatggagacaagctgctgtatcccggcgactatagc
 G  S  L  V  R  V  D  E  N  G  D  K  L  L  Y  P  G  D  Y  S gttttgattgacgtgccggacaagcctctggcgagcgtcaatttcacgctgacaggcgat
 V  L  I  D  V  P  D  K  P  L  A  S  V  N  F  T  L  T  G  D gaggctggcactgtgattgagcgttggccgaggctgaacgcggataggaaggggggctgga
 E  A  G  T  V  I  E  R  W  P  R  L  N  A  D  R  K  G  A  G gtggagaatgtgccggcggattattatgaaggtgggtttggggagtgagcaggaggtgttg
 V  E  N  V  P  A  D  Y  Y  E  G  G  F  G  S  E  Q  E  V  L taa
 -
```

-continued

SEQ ID NO: 270
LENGTH: 800
TYPE: PRT
ORGANISM: M. phaseolina
MPLRTGIAGVAALAAQASAVSLTAFGFPDCVNGPLKDNLVCDSSATPLARATALVKELTLEEKLNNTGNTSPG

VPRLGIPEYQWWNEALHGVAFTYPGQPMTESGNFSSATSFPQPILMGAAFDDELIYEVASVVSTEARAYSNGG

RSGLDYWTPNINPYKDPRWGRGQETPGEDPFHLASYVQNLIRGLEGNQNDPYKKIVATCKHFTGYDMENWNGN

FRYQFDAQINMRDMVEYYMPPFQACAREAKVGAFMCSYNAVNGVPTCADPWLLQTVLREHWGWNQEDQWVVSD

CDAIQNVYLPHEWAESREQAVADTLNAGTDLNCGTYYQRYLPGAYEQGLINDTTLDRALTRTYSSLIKLGYFD

NADSQPYRQIGWQDVNSQHAQELALKAAQEGIVLLKNDGLLPLSLDGVSSIALIGSWANATEQMQGNYAGVAP

YLHSPLYAAEQLGVKVNYAEGASQSNPTTDQWGAEYTAAENSDVIIVVGGIDNDIESEELDRVAIAWSGPQLD

MITKLATYGKPVIVVQMGAGQLDSTPLVSNANISALLWGGYPGQDGGTALFDIITGAVAPAGRLPITQYPARY

TKEVAMTDMSLRPSSTSAGRTYKWYNGTAVFPFGFGLHYTNFSAAIPSPPASSFAISDLVASCSANDTSKLDL

CPFTSLAVDIANDGTRASDFVALAFLTGEFGPSPHPKSSLVAYQRLHAIAAGETQTARLNLTLGSLVRVDENG

DKLLYPGDYSVLIDVPDKPLASVNFTLTGDEAGTVIERWPRLNADRKGAGVENVPADYYEGGFGSEQEVL*

SEQ ID NO: 271
LENGTH: 3836 (including 150 bp 5' UTR and 150 bp 3' UTR)
TYPE: DNA
ORGANISM: M. phaseolina
AAACGGGCCGGGGCAGTCTCTCAGTTCTCGCCATGTTTCGCCCACGAAGGTGGGATGTCTTGCCATGCTTTAT

AGATGCTGCGCCCCAAGGACCATATCAAAGCTTAACTGCCATCCCCGACATTTCGCCTTGGCCGCCCTAACCA

CAAAATGAGGCCTCGCAGTGCCGCCGTCTTTTTGCTTACCTTTTCACACATCCTCCCCGGTTGTTGTTTGCAA

CCGCGGGAATCCGGCAATGGAACGACAACCAAGGATGCTTTTATCGACAACCTAGTTTCGCAGATGACTGTCG

CAGACCTTGGTATGCTACTCCATCACCAGCGCAGTTCCTCCGGTCCTTCCCAAAGCAGCAAAAATCAAAGACT

AGGGCCAGCGAAGAATGTGTGTGTACTGCCTTGCGCGGCGTGATAAAGCAGCTCGAGGATTTCTCCACCCGGG

TTTCCTCGTCCTCAGTTTTTTTACCGCCCCGTAATTGATCCGTTTCGACAAAAGCATTGAAGTTGGATCTTGC

CAAAAAAAAAAAAAAAAACATCACGACCAGACTCTGGATGAGGAAGTGCAGATCGATCCTATCCCCTGCATTG

AACGCACCAGACGTCCATCTGAACCCACAAACTAACAATATGAACAGTGCTACAGCTCCACTTGATGTTCGGA

GACAATATTGTTGGGCCCAGAAGTCAAATGAGCTCTACGGTGAGCACACAGCTGCTTCTCTTGATCCATTCA

CTCATTGAACATGCAGACCTCGCCATGCGGGCTGCCCCAGATGCAGCTGTGGGAAACATACACGATTGGTCTG

CCCTCGTCTCTTCTTTATAGACGTATGCTAACTCGAAACAGGTACCCCTTGAATACGTCCTACTACAATGGAA

TGCAGCAGCTCGTAGCCAAAAAGGCCCGCCTACATGTCCCGTTTTTGCACTTCGGAGAATGCTTGCACGGAGT

CGGCTCGTACAAGCAGTCCATGTTTCCTCGTAATCCAAGCCGCACCCAATTCTGGCCCCCGTGCATGTTGCTA

AGTTATTTCAGAATCCATCGGTCTTTCCGCCTCCTTTGATGCTGACCTAGTATATCGCGTTGGCCGAGCTATC

GGCACTGAAGCCAGGTCCATCGGCGTCCACGCTTGCCTCTCCCCGTACTGGATCTTTCGGGAAAAGAGCCCC

GGTTCGGCAGGCTCCAGGAAGCTTGGGGTGAAGATAAGGTTCTAACATCCATCATGGGTGTTGCTTATGCTTC

CGGCCTTTCTAAGAATGGATCCTGGTCTGATCCCGATGCCGTCGCTCCCGTGATGAAGCACTTTGCCGCTTAC

GGTGCACCGCAATCGGGGCTTAATGCCGCACCATGGATAGGTCATGGCAACAGGGAGATACTGGAGGAGCTCC

TTATGCCTTTCAAAGCTGTTGTCAACCTCGGCGGCGTTCGGGGCGTCATGATGGCTTACAACGAGCTTGATGG

CATCCCCGCTCATGTTTCACCGCTGCTATACCAGGCTTTAGAGGACTGGGAATTCGATGGCTTTGTAATGGGA

GACGACTGGGAGTTTCAATGTTGGAAGGCCGCCATCAGGTATCAACTGGCCCAGCAGATACTCTCACGGTAA

GTTGATCTTCTTCAGGAACCCATGACCTGCAAAGTTGACTGAACCGCTATAGCAATGGTTCAACGCCGGTGGA

ATGATCCAATTCTACGACTATTCCTTGGACGACTTTCTGAATACCACAGCGGGCCTTGTGTCAAATGGCAGCG

TGCCGCTTTCAACCCTCCAGGCTCACATAAAGAGGATATTGGGAGTGAAGTACGATCTTGGTCTATTCTCGGA

CTCTCTTATTTCGGACTCAATTGATCCGCAGGCTATTACGGCCTCTCACGTCCCACTTACTCGAGAAGCAGCA

-continued

```
CATAAAAGCATAGTGTTGCTGGATAATCACAATTCGACTCTCCCTTTAAAGCCCGCGGACCAGGGGATCCAAA
AGCTTGCGCTCATAGGTCCCTTCATCGACACTCTGAACTGTGGCGACTACTCTGGGACCTTCGGTGCATTTCC
CGTGGCAAACTCATCAACACTTCTGCAGGCTGTGCTGGCACATACAGCCTCGCTCGAATATCCGGTCGAACTG
ATAACGGCATGGGGGGCAAACCAATGGTTGTACAATCAGCAAGTCCCCATTGCCGGGTACCACCTCTCTCCAC
CAAACAGCAGCAATAGTAGCGGCGGAGGCGAGGGGCTACTCGCAACATATTACGCAGACACAAACTTCACGAC
GCCGCTTGTCCGGACTATCGAAACACCGTTCCTTGATTGGGGCCTTTATCCTCCATCAGGTCTTCCGTCGAAC
AACTTCTCCGCAATATGGGAAGGAATCATCACCGTGCCCTCCACGCTGACCGAGGCCGTGGAAGGCTACCTTG
GCGTGGCAGTCTACGCCAACACCACCGCAACCCTCTACATCGACTCCCAACCCCTTGTCACCTCCCCACTCAC
CACATCCGGCAACTTCCTCTCCAACATCCAGTCCCGTACCTGGGCGGCCGTCAACAGCACCGCTGCACCTCCC
GGCTCCGCCCCCTTCACCTTCCACCCTGGCGCCCGCCACCGCATCCGCATCACCTACCAAGCGTACAACTTGT
ACCAAAAGATCGAAAACCAGAACAGCCTCAACGCGCAGATCCTCCTTTTCTGGAACCTCGTTGACCGGCGCCA
GCAGCAACAGCAACATCCCGCCAACAGCCCTCCCGCGGCCCTGGCGCAAGCCATCTCCGCCGCCCACGCCGCC
GACGCTATCATCCTGCATCTCGGCAGCGGCTGGTCCTCCGACGGCGAGGGCGGCGACCGCGCCTCGCTCTCGC
TGTCCCCCAACCAATCCGCGCTCGCTGACGCCGTCTTTGGCGCCGCCGCCTCGGCCAACAAACCCGTCGTGCT
CGTCCTGACGGGCGGCAGGCCGCTCGCGATACCCGAGTACTACAACCGATCGAGCGCGGTGCTGCACACGTTC
TTCCCCGGGCAGCAGGGCGGGAGTGCCGTCGCGGATGTGTTGTTCGGGGCGGTGAATCCGGGCGGGCGGATGC
CGGTGAGTGTGGCGAGGGGGGTGGGGCAGTTGCCGGTGTTCTATAATTATAAGTGAGTCTTGCGAGTGCTTCG
CTCGTAGCCTTTTTGCTTCGGTCTTCGGGGAGGAAGAGCGTCACTGACGATCGGACGGACAAGGTACACTGCG
CGCGCTGTCACGTACCTGGATGAAGAGAACACACCTGCGTATCCTTTCGGCTATGGCCTCAGCTACTCGAACT
TCTCCGCGGGCGGGTTGACTGCTTCTGTTGTGCGGAATGGAAGCGTCGTTGCTGATGGGCCTGCGGCAACGTT
CGCAGCTGGGGATTACTTACGGTTTGGTGTTCCTGTGAGTAACGAGGGGCCCGTGCCTGGCAGCTATGTTGTA
CAGGTGTATCTACTGCAGCGTGTTTCGCAGATTACGCAGCCGGCCAAGCAGCTCGTTGCATTTTCGAGGCTAT
ACTTGGAGGTCGGGGAGGAGAGGACGGTAGATCTGGAGGTTGAGGTTGACAGATATCTGAGGATATTGGATAG
GAAGATGGAATGGCGAGTGGAGAGCGGTGAATATACGTTTGCGGTGCTGAGTGATGGTGGTGTAACGGCGGAG
CAGGCAGGGAACGTCACGATGAGGTGCACCGAATAAGCACGTCGGTGGGTTTGTTGTTTTGGCATGGACTCGG
GCGAGGGGAAAGTCAGTGTATCAGCGAAAGTGGGTGGTAGGGCTGTGGCTTGCACCTTTAAGAACGAGGCCAC
CGGCTTAGGTCCGAGTATTCGGCTTTTTGTGTAGTAGTTT
```

```
SEQ ID NO: 272
LENGTH: 2916
TYPE: DNA
ORGANISM: M. phaseolina
FEATURE NAME/KEY: CDS
LOCATION: (1)...(2916)
atgaggcctcgcagtgccgccgtcttttgcttaccttttcacacatcctccccggttgt
 M   R   P   R   S   A   A   V   F   L   L   T   F   S   H   I   L   P   G   C tgtttgcaaccgcgggaatccggcaatggaacgacaaccaaggatgcttttatcgacaac
 C   L   Q   P   R   E   S   G   N   G   T   T   T   K   D   A   F   I   D   N ctagtttcgcagatgactgtcgcagaccttgtgctacagctccacttgatgttcggagac
 L   V   S   Q   M   T   V   A   D   L   V   L   Q   L   H   L   M   F   G   D aatattgttgggcccagaagtcaaaatgagctctacgacctcgccatgcgggctgcccca
 N   I   V   G   P   R   S   Q   N   E   L   Y   D   L   A   M   R   A   A   P gatgcagctgtggggaaacatacacgattggtaccccttgaatacgtcctactacaatgga
 D   A   A   V   G   N   I   H   D   W   Y   P   L   N   T   S   Y   Y   N   G atgcagcagctcgtagccaaaaaggcccgcctacatgtcccgttttgcacttcggagaa
 M   Q   Q   L   V   A   K   K   A   R   L   H   V   P   F   L   H   F   G   E tgcttgcacggagtcggctcgtacaagcagtccatgtttcctcaatccatcggtctttcc
 C   L   H   G   V   G   S   Y   K   Q   S   M   F   P   Q   S   I   G   L   S
```

-continued

```
gcctcctttgatgctgacctagtatatcgcgttggccgagctatcggcactgaagccagg
 A  S  F  D  A  D  L  V  Y  R  V  G  R  A  I  G  T  E  A  R tccatcggcgtccacgcttgcctctcccccgtactggatctttcggaaaagagccccgg
 S  I  G  V  H  A  C  L  S  P  V  L  D  L  S  G  K  E  P  R ttcggcaggctccaggaagcttggggtgaagataaggttctaacatccatcatgggtgtt
 F  G  R  L  Q  E  A  W  G  E  D  K  V  L  T  S  I  M  G  V gcttatgcttccggcctttctaagaatggatcctggtctgatcccgatgccgtcgctccc
 A  Y  A  S  G  L  S  K  N  G  S  W  S  D  P  D  A  V  A  P gtgatgaagcactttgccgcttacggtgcaccgcaatcggggcttaatgccgcaccatgg
 V  M  K  H  F  A  A  Y  G  A  P  Q  S  G  L  N  A  A  P  W ataggtcatggcaacagggagatactggaggagctccttatgcctttcaaagctgttgtc
 I  G  H  G  N  R  E  I  L  E  E  L  L  M  P  F  K  A  V  V aacctcggcggcgttcggggcgtcatgatggcttacaacgagcttgatggcatccccgct
 N  L  G  G  V  R  G  V  M  M  A  Y  N  E  L  D  G  I  P  A catgtttcaccgctgctataccaggctttagaggactgggaattcgatggctttgtaatg
 H  V  S  P  L  L  Y  Q  A  L  E  D  W  E  F  D  G  F  V  M ggagacgacttggagtttcaatgttggaaggccgccatcaggtatcaactggcccagca
 G  D  D  L  G  V  S  M  L  E  G  R  H  Q  V  S  T  G  P  A gatactctcacgcaatggttcaacgccggtggaatgatccaattctacgactattccttg
 D  T  L  T  Q  W  F  N  A  G  G  M  I  Q  F  Y  D  Y  S  L gacgactttctgaataccacagcgggccttgtgtcaaatggcagcgtgccgctttcaacc
 D  D  F  L  N  T  T  A  G  L  V  S  N  G  S  V  P  L  S  T ctccaggctcacataaagaggatattgggagtgaagtacgatcttggtctattctcggac
 L  Q  A  H  I  K  R  I  L  G  V  K  Y  D  L  G  L  F  S  D tctcttatttcggactcaattgatccgcaggctattacgcctctcacgtcccacttact
 S  L  I  S  D  S  I  D  P  Q  A  I  T  A  S  H  V  P  L  T cgagaagcagcacataaaagcatagtgttgctggataatcacaattcgactctcccttta
 R  E  A  A  H  K  S  I  V  L  L  D  N  H  N  S  T  L  P  L aagcccgcggaccaggggatccaaaagcttgcgctcataggtcccttcatcgacactctg
 K  P  A  D  Q  G  I  Q  K  L  A  L  I  G  P  F  I  D  T  L aactgtggcgactactctgggaccttcggtgcatttcccgtggcaaactcatcaacactt
 N  C  G  D  Y  S  G  T  F  G  A  F  P  V  A  N  S  S  T  L ctgcaggctgtgctggcacatacagcctcgctcgaatatccggtcgaactgataacggca
 L  Q  A  V  L  A  H  T  A  S  L  E  Y  P  V  E  L  I  T  A tgggggggcaaaccaatggttgtacaatcagcaagtccccattgccgggtaccacctctct
 W  G  A  N  Q  W  L  Y  N  Q  Q  V  P  I  A  G  Y  H  L  S ccaccaaacagcagcaatagtagcggcggaggcgaggggctactcgcaacatattacgca
 P  P  N  S  S  N  S  S  G  G  G  E  G  L  L  A  T  Y  Y  A gacacaaacttcacgacgccgcttgtccggactatcgaaacaccgttccttgattggggc
 D  T  N  F  T  T  P  L  V  R  T  I  E  T  P  F  L  D  W  G ctttatcctccatcaggtcttccgtcgaacaacttctccgcaatatgggaaggaatcatc
 L  Y  P  P  S  G  L  P  S  N  N  F  S  A  I  W  E  G  I  I accgtgccctccacgctgaccgaggccgtggaaggctaccttggcgtggcagtctacgcc
 T  V  P  S  T  L  T  E  A  V  E  G  Y  L  G  V  A  V  Y  A aacaccaccgcaaccctctacatcgactcccaaccccttgtcacctcccactcaccaca
 N  T  T  A  T  L  Y  I  D  S  Q  P  L  V  T  S  P  L  T  T tccggcaacttcctctccaacatccagtcccgtacctgggcggccgtcaacagcaccgct
 S  G  N  F  L  S  N  I  Q  S  R  T  W  A  A  V  N  S  T  A gcacctcccggctccgccccctcaccttccaccctggcgcccgccaccgcatccgcatc
 A  P  P  G  S  A  P  F  T  F  H  P  G  A  R  H  R  I  R  I acctaccaagcgtacaacttgtaccaaaagatcgaaaaccagaacagcctcaacgcgcag
 T  Y  Q  A  Y  N  L  Y  Q  K  I  E  N  Q  N  S  L  N  A  Q atcctcctttctggaacctcgttgaccggcgccagcagcaacagcaacatcccgccaac
 I  L  L  F  W  N  L  V  D  R  R  Q  Q  Q  Q  H  P  A  N
```

```
agccctcccgcggccctggcgcaagccatctccgccgccacgccgccgacgctatcatc
 S  P  P  A  A  L  A  Q  A  I  S  A  A  H  A  A  D  A  I  I ctgcatctcggcagcggctggtcctccgacggcgagggcggcgaccgcgcctcgctctcg
 L  H  L  G  S  G  W  S  S  D  G  E  G  G  D  R  A  S  L  S ctgtcccccaaccaatccgcgctcgctgacgccgtctttggcgccgccgcctcggccaac
 L  S  P  N  Q  S  A  L  A  D  A  V  F  G  A  A  A  S  A  N aaacccgtcgtgctcgtcctgacgggcggcaggccgctcgcgatacccgagtactacaac
 K  P  V  V  L  V  L  T  G  G  R  P  L  A  I  P  E  Y  Y  N cgatcgagcgcggtgctgcacacgttcttccccgggcagcagggcgggagtgccgtcgcg
 R  S  S  A  V  L  H  T  F  F  P  G  Q  Q  G  G  S  A  V  A gatgtgttgttcggggcggtgaatccgggcgggcggatgccggtgagtgtggcgaggggg
 D  V  L  F  G  A  V  N  P  G  G  R  M  P  V  S  V  A  R  G gtggggcagttgccggtgttctataattataagtacactgcgcgcgctgtcacgtacctg
 V  G  Q  L  P  V  F  Y  N  Y  K  Y  T  A  R  A  V  T  Y  L gatgaagagaacacacctgcgtatccttctggctatggcctcagctactcgaacttctcc
 D  E  E  N  T  P  A  Y  P  F  G  Y  G  L  S  Y  S  N  F  S gcgggcgggttgactgcttctgttgtgcggaatggaagcgtcgttgctgatgggcctgcg
 A  G  G  L  T  A  S  V  V  R  N  G  S  V  V  A  D  G  P  A gcaacgttcgcagctggggattacttacggtttggtgttcctgtgagtaacgaggggccc
 A  T  F  A  A  G  D  Y  L  R  F  G  V  P  V  S  N  E  G  P gtgcctggcagctatgttgtacaggtgtatctactgcagcgtgtttcgcagattacgcag
 V  P  G  S  Y  V  V  Q  V  Y  L  L  Q  R  V  S  Q  I  I  Q ccggccaagcagctcgttgcattttcgaggctatacttggaggtcggggaggagaggacg
 P  A  K  Q  L  V  A  F  S  R  L  Y  L  E  V  G  E  E  R  T gtagatctggaggttgaggttgacagatatctgaggatattggataggaagatggaatgg
 V  D  L  E  V  E  V  D  R  Y  L  R  I  L  D  R  K  M  E  W cgagtggagagcggtgaatatacgtttgcggtgctgagtgatggtggtgtaacggcggag
 R  V  E  S  G  E  Y  T  F  A  V  L  S  D  G  G  V  T  A  E caggcagggaacgtcacgatgaggtgcaccgaataa
 Q  A  G  N  V  T  M  R  C  T  E  -

SEQ ID NO: 273
LENGTH: 971
TYPE: PRT
ORGANISM: M. phaseolina
MRPRSAAVFLLTFSHILPGCCLQPRESGNGTTTKDAFIDNLVSQMTVADLVLQLHLMFGDNIVGPRSQNELYD

LAMRAAPDAAVGNIHDWYPLNTSYYNGMQQLVAKKARLHVPFLHFGECLHGVGSYKQSMFPQSIGLSASFDAD

LVYRVGRAIGTEARSIGVHACLSPVLDLSGKEPRFGRLQEAWGEDKVLTSIMGVAYASGLSKNGSWSDPDAVA

PVMKHFAAYGAPQSGLNAAPWIGHGNREILEELLMPFKAVVNLGGVRGVMMAYNELDGIPAHVSPLLYQALED

WEFDGFVMGDDLGVSMLEGRHQVSTGPADTLTQWFNAGGMIQFYDYSLDDFLNTTAGLVSNGSVPLSTLQAHI

KRILGVKYDLGLFSDSLISDSIDPQAITASHVPLTREAAHKSIVLLDNHNSTLPLKPADQGIQKLALIGPFID

TLNCGDYSGTFGAFPVANSSTLLQAVLAHTASLEYPVELITAWGANQWLYNQQVPIAGYHLSPPNSSNSSGGG

EGLLATYYADTNFTTPLVRTIETPFLDWGLYPPSGLPSNNFSAIWEGIITVPSTLTEAVEGYLGVAVYANTTA

TLYIDSQPLVTSPLTTSGNFLSNIQSRTWAAVNSTAAPPGSAPFTFHPGARHRIRITYQAYNLYQKIENQNSL

NAQILLFWNLVDRRQQQQQHPANSPPAALAQAISAAHAADAIILHLGSGWSSDGEGGDRASLSLSPNQSALAD

AVFGAAASANKPVVLVLTGGRPLAIPEYYNRSSAVLHTFFPGQQGGSAVADVLFGAVNPGGRMPVSVARGVGQ

LPVFYNYKYTARAVTYLDEENTPAYPFGYGLSYSNFSAGGLTASVVRNGSVVADGPAATFAAGDYLRFGVPVS

NEGPVPGSYVVQVYLLQRVSQIIQPAKQLVAFSRLYLEVGEERTVDLEVEVDRYLRILDRKMEWRVESGEYTF

AVLSDGGVTAEQAGNVTMRCTE*
```

SEQ ID NO: 274
LENGTH: 1278 (including 150 bp 5' UTR and 150 bp 3' UTR)
TYPE: DNA
ORGANISM: M. phaseolina
CACGCCCCGCGGCAGCTTCCACGACATCATAAAAGAACTTCAAGTGCCAAATCGAGGCATGAATTAAGAAAAC

ACGCATCCGCTAAATCAACACTCTACCAGTCCCTTGTGCGTCCTTTGACCCACGTCTCTGCAGTGCAGATCAG

CAGCATGGCTCCGGATCCGCTAGTCACCCACATCTACACCGCAGACCCATCAGCGCACGTGTTCGAAGGGAAA

CTCTACATCTATCCGTCGCACGACCGGGAAACGGATATCAAATTCAACGACAACGGCGACCAGTATGACATGA

ACGACTACCACGTGCTCTCACTCGAGGCACCCGGCGGCCCGGCCACTGACCACGGAGTTGCGCTGAGAGCGGA

GGACGTGCCATGGGTTTCGAAGCAGCTGTGGGCACCCGACGCTGCTACCAAGAACGGCAACTACTATCTCTAC

TTTCCGGCACGCGACAAGGAGGGAATCTTCCGCATTGGCGTTGCTGTGTCAGACTCGCCATCGGGCCCTTTCA

AGCCAGAACCAGAGCCAATCAAGGGATCTTACAGCATCGACCCGGCCAGCTTTGTGGATGACGATGGCAGCGC

CTACCTGTACTTTGGGGGCATCTGGGGTGGCCAGCTGCAGTGTTGGCGGGCAGACGGCACTTTTGACCCCTCG

CAGTCGGGTCCGCACGAGCCGTCCGGCGCCGGTGTGCCTGCGCTGCTTCCACGAGTGGCTCGCCTGCGGGACG

ATATGCTGGAGTTTGACAGCCCGCCGCAGGAGCTGCTGCTCCTCGACGAATCAACGGGGAAGCCTCTGGCAGC

GGATGACCACGATCGGCGCTTCTTCGAAGCTGCATGGATGCACAAATACCAGGGCAAATACTACTTCTCCTAC

TCGACGGGCGATACGCACTACCTGGTCTACGCCACCGGAGACAGCCCGCTCGGGCCGTTCACGTACCAAGGAA

GGATCCTGGAGCCAGTGCTGGGTTGGACAACGCATCATTCCATTGCCGAATTCAAGGGAAAATGGTATCTATT

CTACCATGACTGCTCCTTGTCGGGAGGCGTTGATCATTTGCGAAGCGTGAAGATGCGGGAGATATTTTACGAT

GCTGAAGGGAGGATTAAGCTGACTCCAGAGTAGCCATTTCAATTTGGATCAACTTAGAAGAGGAGGAGAGATT

ATCAGCACTGGATGGCATGACCTCATTTGCATATTTGGGCAAGATTCGTTGCCTCCAATCCACATGGGACAAT

CCAAACGCTGAAAATTAAAAAAAAAAAAAAAAAAAAAA

SEQ ID NO: 275
LENGTH: 978
TYPE: DNA
ORGANISM: M. phaseolina
FEATURE NAME/KEY: CDS
LOCATION: (1)...(978)

```
atggctccggatccgctagtcacccacatctacaccgcagacccatcagcgcacgtgttc
 M   A   P   D   P   L   V   T   H   I   Y   T   A   D   P   S   A   H   V   F gaagggaaactctacatctatccgtcgcacgaccgggaaacggatatcaaattcaacgac
 E   G   K   L   Y   I   Y   P   S   H   D   R   E   T   D   I   K   F   N   D aacggcgaccagtatgacatgaacgactaccacgtgctctcactcgaggcacccggcggc
 N   G   D   Q   Y   D   M   N   D   Y   H   V   L   S   L   E   A   P   G   G ccggccactgaccacggagttgcgctgagagcggaggacgtgccatgggtttcgaagcag
 P   A   T   D   H   G   V   A   L   R   A   E   D   V   P   W   V   S   K   Q ctgtgggcacccgacgctgctaccaagaacggcaactactatctctactttccggcacgc
 L   W   A   P   D   A   A   T   K   N   G   N   Y   Y   L   Y   F   P   A   R gacaaggagggaatcttccgcattggcgttgctgtgtcagactcgccatcgggccctttc
 D   K   E   G   I   F   R   I   G   V   A   V   S   D   S   P   S   G   P   F aagccagaaccagagccaatcaagggatcttacagcatcgacccggccagctttgtggat
 K   P   E   P   E   P   I   K   G   S   Y   S   I   D   P   A   S   F   V   D gacgatggcagcgcctacctgtactttgggggcatctggggtggccagctgcagtgttgg
 D   D   G   S   A   Y   L   Y   F   G   G   I   W   G   G   Q   L   Q   C   W cgggcagacggcacttttgacccctcgcagtcgggtccgcacgagccgtccggcgccggt
 R   A   D   G   T   F   D   P   S   Q   S   G   P   H   E   P   S   G   A   G gtgcctgcgctgcttccacgagtggctcgcctgcgggacgatatgctggagtttgacagc
 V   P   A   L   L   P   R   V   A   R   L   R   D   D   M   L   E   F   D   S ccgccgcaggagctgctgctcctcgacgaatcaacggggaagcctctggcagcggatgac
 P   P   Q   E   L   L   L   L   D   E   S   T   G   K   P   L   A   A   D   D cacgatcggcgcttcttcgaagctgcatggatgcacaaataccagggcaaatactacttc
 H   D   R   R   F   F   E   A   A   W   M   H   K   Y   Q   G   K   Y   Y   F
```

```
tcctactcgacgggcgatacgcactacctggtctacgccaccggagacagcccgctcggg
 S  Y  S  T  G  D  T  H  Y  L  V  Y  A  T  G  D  S  P  L  G ccgttcacgtaccaaggaaggatcctggagccagtgctgggttggacaacgcatcattcc
 P  F  T  Y  Q  G  R  I  L  E  P  V  L  G  W  T  T  H  H  S attgccgaattcaagggaaaatggtatctattctaccatgactgctccttgtcgggaggc
 I  A  E  F  K  G  K  W  Y  L  F  Y  H  D  C  S  L  S  G  G gttgatcatttgcgaagcgtgaagatgcgggagatattttacgatgctgaagggaggatt
 V  D  H  L  R  S  V  K  M  R  E  I  F  Y  D  A  E  G  R  I aagctgactccagagtag
 K  L  T  P  E  -
```

SEQ ID NO: 276
LENGTH: 325
TYPE: PRT
ORGANISM: *M. phaseolina*
MAPDPLVTHIYTADPSAHVFEGKLYIYPSHDRETDIKENDNGDQYDMNDYHVLSLEAPGGPATDHGVALRAED

VPWVSKQLWAPDAATKNGNYYLYFPARDKEGIFRIGVAVSDSPSGPFKPEPEPIKGSYSIDPASFVDDDGSAY

LYFGGIWGGQLQCWRADGTFDPSQSGPHEPSGAGVPALLPRVARLRDDMLEFDSPPQELLLLDESTGKPLAAD

DHDRRFFEAAWMHKYQGKYYFSYSTGDTHYLVYATGDSPLGPFTYQGRILEPVLGWTTHHSIAEFKGKWYLFY

HDCSLSGGVDHLRSVKMREIFYDAEGRIKLTPE*

SEQ ID NO: 277
LENGTH: 2078 (including 150 bp 5' UTR and 150 bp 3' UTR)
TYPE: DNA
ORGANISM: *M. phaseolina*
TACGAAAAATCGGCGCGAATACGGAAAGTGGTGGTAAATCCAGCTGATTCCCTTGTTCAAAGTCGATAAAGAG

GGACGTGCTAGCTTGTCAACTTAGAAATACATTCCACTTCAATCACAGGCTGTAAGACCTACCTCCGTTCAAT

AACCATGATTTCCAAATCACTGCTCTTTGTGTGGGCTGCTATCGTTACGGTTGCCGTCCATGCGGATTCCTAC

ATTAATCCTGTGCTTCCAGGCTTCCACCCCGACCCTTCCTGTATCTACGTTGAGGAACAAAATCAGACTTTCT

TCTGCGCAACTTCCAGTTTCAGTGTTTTCCCCGGCATCCCGATTCATGCCAGCAGAGACCTTACGAACTGGAA

GCTGGCCAGCAACGTCCTGAACCGCCGATCCCAGCTCCCTGAGTTCGCCTCCACCCCCACCGGCCAAGATGGT

ATTTTCGCACCCACGCTCCGCTACAACAACGGCACCTTCTACCTGATCACAAGCTGGGTCTCCGTCACCTCGT

ACCAGAACTTCAAGATGGACAACATCATCTTCACGACCACCGACCCTTTCAACTCTGCCTCCTGGAGCGACCC

CACGCACTTCGACTTCCTCGGCTACGACCCCAGCCTCTTCTGGGACACGGACGGCGTCGCCTATCTCACCGGC

GCGCGCGCGACCACCACCGGCACAGCCATCGCTCTCGCCCCGTTCGACCCTTCCACCGGAGCCTACCTCGGAA

AAACTACCTATCCGTACGTTGATGCCGTCCCCATCCGCCTCTCAATGCCGAGCATCTACTGATAATGCACAGC

TACAACGGCACCGGCATCGGAACCCCTGAGGGTCCGCACCTCTACCACAACACCGCCTCCGGTTGGTACTACC

TCCTCATCGCCGAAGGCGGGACCGCTGCCCGGCACCGCGGCTCCATCGCGCGGTCCCGCAGCGTCGCCGGCCC

GTACGAGGATTGCCCGCACAACCCAGTCGTGCACGCCGCGAGCAATGCGAGTCTGATACAGAGCGTCGGACAC

GCCGATATCTTTCAGGACGGCAACGGTCAGTGGTGGGCGTTGCGCTGGCGCAGCGGGCAGGCGGGAGGGGAT

TTGAGAGCGTTCCCATGGGGAGAGAGACGGTCTTATTTCCGGTACAGTGGAGTGAAGACGGGTGGCTGAAAGT

TGAGGGCGAGGTGGAGGGTGTGATGGAGGGCCCACTTCCACGAGAGAGCAGGGAGGGCGTGTGGCACGATGAA

CCCGATATTGTGGACTTCGAGCCAGGCATGACACTGCCACCGCATTTCGTGCACGTGCGGGTGCCGGTTGAAG

ATGCGTACGTGGTGGGCCCTTTGGGGAGAGAGGGCAGCTTGGAGTTGGTGCCGAGCGTAAGGAGCTTGTCGAC

CAAGGGGGGTGGAAATACAACAGAGGGGACAACGTTCGTCGGGAGAAGGCAGGTTGACACGCTGTTCACATAC

AGCGTAGATTTGGAATTTGATCCGAGACGGATTGGTGATGAGGCGGGCGTAACGGTGTATCTGGATGAGACCA

GGCATATCGATTTGGGCGTTCTGATGACTGAGGATGGAGGAAAGCATCTCCGGTTGAGGGCTGTGAGCTCAAA

CCATAACACGACGACACACAAAGATATTAACGCGGCGTGGCCAAGCAAAAACGGGAAAGCTCGATTGGAGATT

CGAGCAGCGAACATTACGCACTACACCTTCTCTGCTGGGATATCGCCATACAAGATGGGAGAGCATACGGACA

-continued

CCGCTGTCATAGGATGTGTAGAGGCAAGTCTTGTGACCGGCGGATACACAGGAACATTGATTGGAACCTACGC

CACAAGCAACGCAATGGAGGGTAAAAATACCGCAAAGGCATACGTTAGTAGATGGAGATATCAGGGGCAAGGT

CAGGAGATCGGGAACGGCCATATTGTTTGAGTTCATGGAGAACGTATAGCCCATGAAATTACATGTTGCTGTC

AAATTCTACTCAAAAAaTAAAAACAAGAATCTGATCATCTCTTTCTAAGTTCTCCAAGTGTCCATTCAATGGG

AAATCTAACCCTTATCCAGTCACCTCTGCTGTAG

```
SEQ ID NO: 278
LENGTH: 1731
TYPE: DNA
ORGANISM: M. phaseolina
FEATURE NAME/KEY: CDS
LOCATION: (1)...(1731)
```
atgatttccaaatcactgctctttgtgtgggctgctatcgttacggttgccgtccatgcg
 M   I   S   K   S   L   L   F   V   W   A   A   I   V   T   A   V   H   A gattcctacattaatcctgtgcttccaggcttccaccccgacccttcctgtatctacgtt
 D   S   Y   I   N   P   V   L   P   G   F   H   P   D   P   S   C   I   Y   V gaggaacaaaatcagactttcttctgcgcaacttccagtttcagtgttttccccggcatc
 E   E   Q   N   Q   T   F   F   C   A   T   S   S   F   S   V   F   P   G   I ccgattcatgccagcagagaccttacgaactggaagctggccagcaacgtcctgaaccgc
 P   I   H   A   S   R   D   L   T   N   W   K   L   A   S   N   V   L   N   R cgatcccagctccctgagttcgcctccaccccaccggccaagatggtattttcgcaccc
 R   S   Q   L   P   E   F   A   S   T   P   T   G   Q   D   G   I   F   A   P acgctccgctacaacaacggcaccttctacctgatcacaagctgggtctccgtcacctcg
 T   L   R   Y   N   N   G   T   F   Y   L   I   T   S   W   V   S   V   T   S taccagaacttcaagatggacaacatcatcttcacgaccaccgaccctttcaactctgcc
 Y   Q   N   F   K   M   D   N   I   I   F   T   T   T   D   P   F   N   S   A tcctggagcgaccccacgcacttcgacttcctcggctacgaccccagcctcttctgggac
 S   W   S   D   P   T   H   F   D   F   L   G   Y   D   P   S   L   F   W   D acggacggcgtcgcctatctcaccggcgcgcgcgcgaccaccaccggacagccatcgct
 T   D   G   V   A   Y   L   T   G   A   R   A   T   T   T   G   T   A   I   A ctcgccccgttcgaccttccaccggagcctacctcggaaaaactacctatccgataatg
 L   A   P   F   D   P   S   T   G   A   Y   L   G   K   T   T   Y   P   I   M cacagctacaacggcaccggcatcggaacccctgagggtccgcacctctaccacaacacc
 H   S   Y   N   G   T   G   I   G   T   P   E   G   P   H   L   Y   H   N   T gcctccggttggtactacctcctcatcgccgaaggcgggaccgctgcccggcaccgcggc
 A   S   G   W   Y   Y   L   L   I   A   E   G   G   T   A   A   R   H   R   G tccatcgcgcggtcccgcagcgtcgccggcccgtacgaggattgcccgcacaacccagtc
 S   I   A   R   S   R   S   V   A   G   P   Y   E   D   C   P   H   N   P   V gtgcacgccgcgagcaatgcgagtctgatacagagcgtcggacacgccgatatctttcag
 V   H   A   A   S   N   A   S   L   I   Q   S   V   G   H   A   D   I   F   Q gacggcaacggtcagtggtgggcgttgcgctggcgcagcgggcaggcgggaggggattt
 D   G   N   G   Q   W   W   G   V   A   L   A   Q   R   A   G   G   R   G   F gagagcgttcccatggggagagagacggtcttatttccggtacagtggagtgaagacggg
 E   S   V   P   M   G   R   E   T   V   L   F   P   V   Q   W   S   E   D   G tggctgaaagttgagggcgaggtggagggtgtgatggagggcccacttccacgagagagc
 W   L   K   V   E   G   E   V   E   G   V   M   E   G   P   L   P   R   E   S agggagggcgtgtggcacgatgaacccgatattgtggacttcgagccaggcatgacactg
 R   E   G   V   W   H   D   E   P   D   I   V   D   F   E   P   G   M   T   L ccaccgcatttcgtgcacgtgcgggtgccggttgaagatgcgtacgtggtgggcccttg
 P   P   H   F   V   H   V   R   V   P   V   E   D   A   Y   V   V   G   P   L gggagagagggcagcttggagttggtgccgagcgtaaggagcttgtcgaccaagggggt
 G   R   E   G   S   L   E   L   V   P   S   V   R   S   L   S   T   K   G   G ggaaatacaacagaggggacaacgttcgtcgggagaaggcaggttgacacgctgttcaca
 G   N   T   T   E   G   T   T   F   V   G   R   R   Q   V   D   T   L   F   T tacagcgtagatttggaatttgatccgagacggattggtgatgaggcgggcgtaacggtg
 Y   S   V   D   L   E   F   D   P   R   R   I   G   D   E   A   G   V   T   V -continued

```
tatctggatgagaccaggcatatcgatttgggcgttctgatgactgaggatggaggaaag
 Y  L  D  E  T  R  H  I  D  L  G  V  L  M  T  E  D  G  G  K catctccggttgagggctgtgagctcaaaccataacacgacgacacacaaagatattaac
 H  L  R  L  R  A  V  S  S  N  H  N  T  T  T  H  K  D  I  N gcggcgtggccaagcaaaaacgggaaagctcgattggagattcgagcagcgaacattacg
 A  A  W  P  S  K  N  G  K  A  R  L  E  I  R  A  A  N  I  T cactacaccttctctgctgggatatcgccatacaagatgggagagcatacggacaccgct
 H  Y  T  F  S  A  G  I  S  P  Y  K  M  G  E  H  T  D  T  A gtcataggatgtgtagaggcaagtcttgtgaccggcggatacacaggaacattgattgga
 V  I  G  C  V  E  A  S  L  V  T  G  G  Y  T  G  T  L  I  G acctacgccacaagcaacgcaatggagggtaaaaataccgcaaaggcatacgttagtaga
 T  Y  A  T  S  N  A  M  E  G  K  N  T  A  K  A  Y  V  S  R tggagatatcaggggcaaggtcaggagatcgggaacggccatattgtttga
 W  R  Y  Q  G  Q  G  Q  E  I  G  N  G  H  I  V  -
```

SEQ ID NO: 279
LENGTH: 576
TYPE: PRT
ORGANISM: *M. phaseolina*

```
MISKSLLFVWAAIVTVAVHADSYINPVLPGFHPDPSCIYVEEQNQTFFCATSSFSVFPGIPIHASRDLTNWKL

ASNVLNRRSQLPEFASTPTGQDGIFAPTLRYNNGTFYLITSWVSVTSYQNFKMDNIIFTTTDPFNSASWSDPT

HFDFLGYDPSLFWDTDGVAYLTGARATTGTAIALAPFDPSTGAYLGKTTYPIMHSYNGTGIGTPEGPHLYHN

TASGWYYLLIAEGGTAARHRGSIARSRSVAGPYEDCPHNPVVHAASNASLIQSVGHADIFQDGNGQWWGVALA

QRAGGRGFESVPMGRETVLFPVQWSEDGWLKVEGEVEGVMEGPLPRESREGVWHDEPDIVDFEPGMTLPPHFV

HVRVPVEDAYVVGPLGREGSLELVPSVRSLSTKGGGNTTEGTTFVGRRQVDTLFTYSVDLEFDPRRIGDEAGV

TVYLDETRHIDLGVLMTEDGGKHLRLRAVSSNHNTTTHKDINAAWPSKNGKARLEIRAANITHYTFSAGISPY

KMGEHTDTAVIGCVEASLVTGGYTGTLIGTYATSNAMEGKNTAKAYVSRWRYQGQGQEIGNGHIV*
```

SEQ ID NO: 280
LENGTH: 2097 (including 150 bp 5' UTR and 150 bp 3' UTR)
TYPE: DNA
ORGANISM: *M. phaseolina*

```
CTAAATATGCTGATTCTTTGCCGGCCGGCTTCCTTCCGATCCCACGGTGTTTCCGAGATCTCGGAACGACCGC

ATTTTTAAAAGTGCTGGTATGCTACTGCAGGCTCCCTTTGCATCAGCCATCAATTGTGAACGAAACCGCGGTC

GAAGATGCTCTTCACACGGGCCGCGCTCGCCGCAGCCCTGGCCTTCATTGCGCCAACAAGCTCTGCTCCCGTC

AATTCCACCATCAACTCCACCTACACCAACCCGATCCTGCCCGGGTGGCATTCCGACCCAACCTGCGTCTTCG

TACCAGAGTTTGATGACACATTTTTCTGCACGGTCTCGACCTTCCTCGGGTTCCCTGGCTTGCCCCTCTACGC

CAGCAAGGACCTCCTGAACTGGAAACACGCCTCCAACACCTTCTCGCGGCCCTCCCAGTTCCCCGACCTCGCC

AACGCCACCTACCAACAAGGCGGCGTCTTCGCGCCCACGCTCCGCTACCGCAACGGCACCTTCTACACCATCG

TCGTCACCGTAGACCCCCTCGTCGGCCTCATCTTCACGACGACCGACCCCTACTCCTCCGCCGCCTGGTCCGA

CCCCGTCCGCTTCGACGCCGTCAGCATCGACGCGGACCTCTTCTGGGACGACGATGTCGACGGGCAGGCCTAC

GTCTCCTTCGCGGGCATCCAGCAAGCCAAGATCGACGTCGAGACGGGGGCGCGCGGCGCCAATTACAGCGTCT

GGAACGGCACGGGCGGGCCCTCGCCCGAGGGGCCGCACGTCTACAAGAAGGACGGCTGGTACTACCTCATGAT

TGCCGAGGGCGGGACCGAGCTTGGCCACACCGAAATCATCGCGCGCTCGAGGAACGTCTCCGGCCCGTACGAG

AGCTATGCCGGTAATCCGATCCTGACGAACAGGAACACTACCGAGTACTTCCAGACGGTCGGCCATGCGGATC

TGTTCCAGGACGGCAACGGCCAGTGGTGGGGCGTGGCGCTGAGCACGCGGTCCGGCCCGGAGTGGGTGAACTA

TCCGATGGGCAGGGAAACGGTGCTGTTCCCGGCGACGTGGGAGGAGGGCGAGTGGCCGGTGCTGCAGCCGGTG

AGGGGCCACATGAGCGGCTGGCCGTTGCCGCCGGCGTCCAGGGACCTGCCGGGAGAGGGGCAGTGGGTGGGGG

ATGCGGATGTTGTCGATTTCGAGCCTGGAGAGAGCGTGCCACCGCATTTCATGTCGTGGAGGTTTGCGCCCGA

GGGCGCTTTCACCGTCGGCGCGGAGGAGAAGCCGAATGCCCTGAAGGTGTTGCCGTCGAAGGCGAACTTGACG
```

-continued

```
GGTGGTTCGGATTTTCAGCCTCGCGACGGCATTTCATTCCTCGCGAGAAGGCAGACGGACACGCTGTTTGAGT

ACAGTGTTGACGTCGAGATCGATGCGGAGGTTGAAGAGGAGGAGGCTGGTGCTACTGTATTCTTGACGCAAGA

CCAACACTTGGATCTCGGTGTTGTCCTGCTCGCATCGAAAGGGTCGTCCGAACTCGCCCCACACTTTAGATTC

CGTGTGAATGGCACAGGCAACAACGAAGGCCCTGCACCGCCGACCGTTGTTGAGCCAGTTCCAGAAGCGTGGT

TGGGTCAGCCATTACGCCTACAGATCCGGGCTGCCAACGACACCCATTACACCTTCTCCGCTGGACCTTCGGG

CGAGGCTGAGCCAGCCAGGGTGCTTGCCTATGCACCTGCTACGATTGTTAGCGCTGGTACCGGACCTTTCACT

GGTAAGTTACACATTTCCTGCTCGGTTGGAATCCTCTTGCAGTTTGCTGATTGTACTTCAGGCGCTTTAGTAG

GTGTATATGCGACAAGCAACGGTGGTTCTGGGACGACGCCTGCCTACTTCAGCAGATGGAGATATGAAGGCAA

GGGTCAGAAAATAGCCGAGGGAGAAATCATCCCCTCCACCTCAAGATGAATTGTTAGGCGGGGAGACTTGAAG

AAGTCGAGAGTGGCGTATCTTTGATGATAGGCGTTTTTCTAGTGAATGAATGACCAAGGAGTGAGGTGCTAAA

TGCATGAGGCCAAAAAGaAAACCaAAaAAAACaAAAAAAaaGAAAAGCAAAAT
```

SEQ ID NO: 281
LENGTH: 1737
TYPE: DNA
ORGANISM: M. phaseolina
FEATURE NAME/KEY: CDS
LOCATION: (1)...(1737)

```
atgctcttcacacgggccgcgctcgccgcagccctggccttcattgcgccaacaagctct
 M   L   F   T   R   A   A   L   A   A   A   L   A   F   I   A   P   T   S   S gctcccgtcaattccaccatcaactccacctacaccaacccgatcctgcccgggtggcat
 A   P   V   N   S   T   I   N   S   T   Y   T   N   P   I   L   P   G   W   H tccgacccaacctgcgtcttcgtaccagagtttgatgacacattttctgcacggtctcg
 S   D   P   T   C   V   F   V   P   E   F   D   D   T   F   F   C   T   V   S accttcctcggggttccctggcttgcccctctacgccagcaaggaccttctgaactggaaa
 T   F   L   G   F   P   G   L   P   L   Y   A   S   K   D   L   L   N   W   K cacgcctccaacaccttctcgcggccctcccagttccccgacctcgccaacgccacctac
 H   A   S   N   T   F   S   R   P   S   Q   F   P   D   L   A   N   A   T   Y caacaaggcggcgtcttcgcgcccacgctccgctaccgcaacggcaccttctacaccatc
 Q   Q   G   G   V   F   A   P   T   L   R   Y   R   N   G   T   F   Y   T   I gtcgtcaccgtagacccctcgtcggcctcatcttcacgacgaccgaccccctactcctcc
 V   V   T   V   D   P   L   V   G   L   I   F   T   T   T   D   P   Y   S   S gccgcctggtccgacccgtccgcttcgacgcgtcagcatcgacgcggacctcttctgg
 A   A   W   S   D   P   V   R   F   D   A   V   S   I   D   A   D   L   F   W gacgacgatgtcgacgggcaggcctacgtctccttcgcgggcatccagcaagccaagatc
 D   D   D   V   D   G   Q   A   Y   V   S   F   A   G   I   Q   Q   A   K   I gacgtcgagacgggggcgcgcggcgccaattacagcgtctggaacggcacgggcgggccc
 D   V   E   T   G   A   R   G   A   N   Y   S   V   W   N   G   T   G   G   P tcgcccgaggggccgcacgtctacaagaaggacggctggtactacctcatgattgccgag
 S   P   E   G   P   H   V   Y   K   K   D   G   W   Y   Y   L   M   I   A   E ggcgggaccgagcttggccacaccgaaatcatcgcgcgctcgaggaacgtctccggcccg
 G   G   T   E   L   G   H   T   E   I   I   A   R   S   R   N   V   S   G   P tacgagagctatgccggtaatccgatcctgacgaacaggaacactaccgagtacttccag
 Y   E   S   Y   A   G   N   P   I   L   T   N   R   N   T   T   E   Y   F   Q acggtcggccatgcggatctgttccaggacggcaacggccagtggtgggcgtggcgctg
 T   V   G   H   A   D   L   F   Q   D   G   N   G   Q   W   W   G   V   A   L agcacgcggtccggcccggagtgggtgaactatccgatgggcagggaaacggtgctgttc
 S   T   R   S   G   P   E   W   V   N   Y   P   M   G   R   E   T   V   L   F ccggcgacgtgggaggagggcgagtggccggtgctgcagccggtgaggggccacatgagc
 P   A   T   W   E   E   G   E   W   P   V   L   Q   P   V   R   G   H   M   S ggctggccgttgccgccggcgtccagggacctgccgggagaggggcagtgggtgggggat
 G   W   P   L   P   P   A   S   R   D   L   P   G   E   G   Q   W   V   G   D gcggatgttgtcgatttcgagcctggagagagcgtgccaccgcatttcatgtcgtggagg
 A   D   V   V   D   F   E   P   G   E   S   V   P   P   H   F   M   S   W   R
```

```
tttgcgcccgagggcgctttcaccgtcggcgcggaggagaagccgaatgccctgaaggtg
 F  A  P  E  G  A  F  T  V  G  A  E  E  K  P  N  A  L  K  V ttgccgtcgaaggcgaacttgacggggtggttcggattttcagcctcgcgacggcatttca
 L  P  S  K  A  N  L  T  G  G  S  D  F  Q  P  R  D  G  I  S ttcctcgcgagaaggcagacggacacgctgtttgagtacagtgttgacgtcgagatcgat
 F  L  A  R  R  Q  T  D  T  L  F  E  Y  S  V  D  V  E  I  D gcggaggttgaagaggaggaggctggtgctactgtattcttgacgcaagaccaacacttg
 A  E  V  E  E  E  E  A  G  A  T  V  F  L  T  Q  D  Q  H  L gatctcggtgttgtcctgctcgcatcgaaagggtcgtccgaactcgccccacactttaga
 D  L  G  V  V  L  L  A  S  K  G  S  S  E  L  A  P  H  F  R ttccgtgtgaatggcacaggcaacaacgaaggccctgcaccgccgaccgttgttgagcca
 F  R  V  N  G  T  G  N  N  E  G  P  A  P  P  T  V  V  E  P gttccagaagcgtggttgggtcagccattacgcctacagatccgggctgccaacgacacc
 V  P  E  A  W  L  G  Q  P  L  R  L  Q  I  R  A  A  N  D  T cattacaccttctccgctggaccttcgggcgaggctgagccagccagggtgcttgcctat
 H  Y  T  F  S  A  G  P  S  G  E  A  E  P  A  R  V  L  A  Y gcacctgctacgattgttagcgctggtaccggaccttttcactggcgctttagtaggtgta
 A  P  A  T  I  V  S  A  G  T  G  P  F  T  G  A  L  V  G  V tatgcgacaagcaacggtggttctgggacgacgcctgcctacttcagcagatggagatat
 Y  A  T  S  N  G  G  S  G  T  T  P  A  Y  F  S  R  W  R  Y gaaggcaagggtcagaaaatagccgagggagaaatcatcccctccacctcaagatga
 E  G  K  G  Q  K  I  A  E  G  E  I  I  P  S  T  S  R  -

SEQ ID NO: 282
LENGTH: 578
TYPE: PRT
ORGANISM: M. phaseolina
MLFTRAALAAALAFIAPTSSAPVNSTINSTYTNPILPGWHSDPTCVFVPEFDDTFFCTVSTFLGFPGLPLYAS

KDLLNWKHASNTFSRPSQFPDLANATYQQGGVFAPTLRYRNGTFYTIVVTVDPLVGLIFTTTDPYSSAAWSDP

VRFDAVSIDADLFWDDDVDGQAYVSFAGIQQAKIDVETGARGANYSVWNGTGGPSPEGPHVYKKDGWYYLMIA

EGGTELGHTEIIARSRNVSGPYESYAGNPILTNRNTTEYFQTVGHADLFQDGNGQWWGVALSTRSGPEWVNYP

MGRETVLFPATWEEGEWPVLQPVRGHMSGWPLPPASRDLPGEGQWVGDADVVDFEPGESVPPHFMSWRFAPEG

AFTVGAEEKPNALKVLPSKANLTGGSDFQPRDGISFLARRQTDTLFEYSVDVEIDAEVEEEEAGATVFLTQDQ

HLDLGVVLLASKGSSELAPHFRFRVNGTGNNEGPAPPTVVEPVPEAWLGQPLRLQIRAANDTHYTFSAGPSGE

AEPARVLAYAPATIVSAGTGPFTGALVGVYATSNGGSGTTPAYFSRWRYEGKGQKIAEGEIIPSTSR*

SEQ ID NO: 283
LENGTH: 2099 (including 150 bp 5' UTR and 150 bp 3' UTR)
TYPE: DNA
ORGANISM: M. phaseolina
CCGGTGGGAGGAGGCGCTTCGGTATGCATGACGATCATGGCGGGAGCGAAGCTGCCTTGCACCCTTAGGATCG

GCGGCTACAAAAGCATGCAATCTCTCTCAAACACTTAGTCGCTTGCGTTTCCACCCGCAGGAAGCATCTTCCT

TGCAATGGAGCTCCGCACTCTGCTCTCTCCTTTCTTCCTCTTTGCGGCGCCTCTGGTCTTGTGCTCAACTGGT

GAGAGTTCGACATATACCAACCCCATCTTACCAGGCTTCCATCCAGATCCAAGCTGCATCCTGGTTGCCGAAT

GGAACCATACtACTTTTTGTGCCAGCTCGAGCTTCCTGGCCTTCCCTGGGATTCCTATCCATGCTAGCAGAGA

CCTCCTGAACTGGAAGCTGATAGGCAATGCCCTGAATCGTCCAGAGCAGCTTCCTGAGCTGGCCAATACCAGC

AGGCAGACTAGCGGCATCTGGGCTCCGACCATCAGATATCACAAAGGTACATTTTACGTTGTGACCACTCTGG

TCCATGATGATCGAGACGCTTTCGATCCACAGCGGTGGGACAACGTCATTTTCTCGTCCAAGGATCCTTACGA

TGACGCGGCCTGGTCTGATGCTGTTCATTTCGCTTTCGAAGGTTATGACACCAGTCCATTCTGGGATGACGAC

GGCCAAGTCTACATGACCGCTTCACATGCATACAAAGTTCGGCCTGGAATCGACCAAATGACCATCGACCTAG

AGACTGGAGAGACGGGGGAGCCTGTCAATCTTTGGAACGGGACCGGAGGACTAGCTCCCGAGGGCCCACATGT

GTACAAAAAAGACGGGCTTTACTACTTGATGGTTGCTGAGGGTGGGACTGGTCTGAACCACATGCAGACGATT
```

```
GCCCGATCCGCTTCCGTCAACGGCCCGTACCATGCATACCAGGGGAATCCCATCCTGTCAAATGCGAACACGA

CGGAGTATTTTCAGACTGTCGGTCACGCGGACCTATTCCAAGACACAGCAGGGAGCTGGTGGGGTGTCGCACT

GGCTACGCGCTCAGGTCCAGAATTTTTGACGTACCCAATGGGGCGTGAAACTGTGCTCTTTCCCGTGACCTGG

ACTGAAGGGGAATGGCCTGTCCTTTCTCCAGTCAGAGGCCGGATGGAAGGATGGCCCCTTCCACCACCAGATC

ACTCCATTGCGGGGACTGATCCTTTCATCTCCTCTCCTGATATCGTCGATTTCGAGCCTGGATCGGCCCTTCC

TCTCCACTTCCTACATTGGCGATTTCCACGCGCAGATGCGTACGAGATTTCACCGCCTGGTCACGACTATAGC

CTGAGGTTGAAGCCTTCAAAGCTGAATCTGACATCATACGATGGACAAAATGCTACGGAAGATCAGACTTTGT

TGGCCAGGCGTCAAGTTGACACATTATTTACATTTAGTGTTGATGTCACATTTTCGCCACAACAACAAGAGGA

AGAAGCGGGAGTAAGCGTGTTTCTAACACAGAACCATCACATCGACCTTGGCATTGTGTTGCTACCCTTGCAA

AATGACTCAGATACATCTCCAACCCTGAAGCCCCACTTCCGCTTCCGCGCGACAAGCTATGTTGCCGTGCCTG

ATCCGGTAGTGGTGCCTGTGCCTGACGCCTGGCTGAACCAATCTTTGAGGCTGGAAATTAAGGCATCCAACGT

AACACATTACGCCTTCTCTGCCGGGCCGACTGCACATCAGTCGCAGATGATGACAGTGGCCTATGGAGCCGGA

AGTCTGGTCAGTTGGGGTTTCACTGGTGAGTGCTCGCTTAGAGGGTTAAACATCGTCTTTTCTGATAGGCGAA

GGCTAATACGGCTATTATAGGGACGCTAGTCGGCGTATATGCTACTACTAACGGCGGAAACGGCACAACAGAT

GCATATGTGAGCCGATGGAGGTATCAGGGTCAGGGTCAATTTATTGATTGAAGGTTATGTTGGATATCACAAT

CTTTTGATGCCCTTCAGGGCCGACTACCGACGCGAGCGCTCATGTGTCGAAAATTCGCTGCCCTCGCTCTATT

CTCGCTAGGATTAAATAATTATGTCAGTCTTCTGGCAACTCATAACAATAGAGCT
```

SEQ ID NO: 284
LENGTH: 1731
TYPE: DNA
ORGANISM: M. phaseolina
FEATURE NAME/KEY: CDS
LOCATION: (1)...(1731)

```
atggagctccgcactctgctctctcctttcttcctcttgcggcgcctctggtcttgtgc
 M   E   L   R   T   L   L   S   P   F   F   L   F   A   A   P   L   V   L   C tcaactggtgagagttcgacatataccaaccccatcttaccaggcttccatccagatcca
 S   T   G   E   S   S   T   Y   T   N   P   I   L   P   G   F   H   P   D   P agctgcatcctggttgccgaatggaaccatactacttttgtgccagctcgagcttcctg
 S   C   I   L   V   A   E   W   N   H   T   T   F   C   A   S   S   S   F   L gccttccctgggattcctatccatgctagcagagacctcctgaactggaagctgataggc
 A   F   P   G   I   P   I   H   A   S   R   D   L   L   N   W   K   L   I   G aatgccctgaatcgtccagagcagcttcctgagctggccaataccagcaggcagactagc
 N   A   L   N   R   P   E   Q   L   P   E   L   A   N   T   S   R   Q   T   S ggcatctgggctccgaccatcagatatcacaaaggtacattttacgttgtgaccactctg
 G   I   W   A   P   T   I   R   Y   H   K   G   T   F   Y   V   V   T   T   L gtccatgatgatcgagacgctttcgatccacagcggtgggacaacgtcatttctcgtcc
 V   H   D   D   R   D   A   F   D   P   Q   R   W   D   N   V   I   F   S   S aaggatccttacgatgacgcggcctggtctgatgctgttcatttcgctttcgaaggttat
 K   D   P   Y   D   D   A   A   W   S   D   A   V   H   F   A   F   E   G   Y gacaccagtccattctgggatgacgacggccaagtctacatgaccgcttcacatgcatac
 D   T   S   P   F   W   D   D   D   G   Q   V   Y   M   T   A   S   H   A   Y aaagttcggcctggaatcgaccaaatgaccatcgacctagagactggagagacgggggag
 K   V   R   P   G   I   D   Q   M   T   I   D   L   E   T   G   E   T   G   E cctgtcaatctttggaacgggaccggaggactagctcccgagggcccacatgtgtacaaa
 P   V   N   L   W   N   G   T   G   G   L   A   P   E   G   P   H   V   Y   K aaagacgggctttactacttgatggttgctgagggtgggactggtctgaaccacatgcag
 K   D   G   L   Y   Y   L   M   V   A   E   G   G   T   G   L   N   H   M   Q acgattgcccgatccgcttccgtcaacggcccgtaccatgcataccaggggaatcccatc
 T   I   A   R   S   A   S   V   N   G   P   Y   H   A   Y   Q   G   N   P   I ctgtcaaatgcgaacacgacggagtattttcagactgtcggtcacgcggacctattccaa
 L   S   N   A   N   T   T   E   Y   F   Q   T   V   G   H   A   D   L   F   Q
```

```
gacacagcagggagctggtggggtgtcgcactggctacgcgctcaggtccagaattttg
 D  T  A  G  S  W  W  G  V  A  L  A  T  R  S  G  P  E  F  L acgtacccaatggggcgtgaaactgtgctctttcccgtgacctggactgaaggggaatgg
 T  Y  P  M  G  R  E  T  V  L  F  P  V  T  W  T  E  G  E  W cctgtcctttctccagtcagaggccgatggaaggatggccccttccaccaccagatcac
 P  V  L  S  P  V  R  G  R  M  E  G  W  P  L  P  P  P  D  H tccattgcggggactgatcctttcatctcctctcctgatatcgtcgatttcgagcctgga
 S  I  A  G  T  D  P  F  I  S  S  P  D  I  V  D  F  E  P  G tcggcccttcctctccacttcctacattggcgatttccacgcgcagatgcgtacgagatt
 S  A  L  P  L  H  F  L  H  W  R  F  P  R  A  D  A  Y  E  I tcaccgcctggtcacgactatagcctgaggttgaagccttcaaagctgaatctgacatca
 S  P  P  G  H  D  Y  S  L  R  L  K  P  S  K  L  N  L  T  S tacgatggacaaaatgctacggaagatcagactttgttggccaggcgtcaagttgacaca
 Y  D  G  Q  N  A  T  E  D  Q  T  L  L  A  R  R  Q  V  D  T ttatttacatttagtgttgatgtcacattttcgccacaacaacaagaggaagaagcggga
 L  F  T  F  S  V  D  V  T  F  S  P  Q  Q  Q  E  E  E  A  G gtaagcgtgtttctaacacagaaccatcacatcgaccttggcattgtgttgctacccttg
 V  S  V  F  L  T  Q  N  H  H  I  D  L  G  I  V  L  L  P  L caaaatgactcagatacatctccaaccctgaagcccacttccgcttccgcgcgacaagc
 Q  N  D  S  D  T  S  P  T  L  K  P  H  F  R  F  R  A  T  S tatgttgccgtgcctgatccggtagtggtgcctgtgcctgacgcctggctgaaccaatct
 Y  V  A  V  P  D  P  V  V  V  P  V  P  D  A  W  L  N  Q  S ttgaggctggaaattaaggcatccaacgtaacacattacgccttctctgccgggccgact
 L  R  L  E  I  K  A  S  N  V  T  H  Y  A  F  S  A  G  P  T gcacatcagtcgcagatgatgacagtggcctatggagccggaagtctggtcagttggggt
 A  H  Q  S  Q  M  M  T  V  A  Y  G  A  G  S  L  V  S  W  G ttcactgggacgctagtcggcgtatatgctactactaacggcggaaacggcacaacagat
 F  T  G  T  L  V  G  V  Y  A  T  T  N  G  G  N  G  T  T  D gcatatgtgagccgatggaggtatcagggtcagggtcaatttattgattga
 A  Y  V  S  R  W  R  Y  Q  G  Q  G  Q  F  I  D  -

SEQ ID NO: 285
LENGTH: 576
TYPE: PRT
ORGANISM: M. phaseolina
MELRTLLSPFFLFAAPLVLCSTGESSTYTNPILPGFHPDPSCILVAEWNHTTFCASSSFLAFPGIPIHASRDL

LNWKLIGNALNRPEQLPELANTSRQTSGIWAPTIRYHKGTFYVVTTLVHDDRDAFDPQRWDNVIFSSKDPYDD

AAWSDAVHFAFEGYDTSPFWDDDGQVYMTASHAYKVRPGIDQMTIDLETGETGEPVNLWNGTGGLAPEGPHVY

KKDGLYYLMVAEGGTGLNHMQTIARSASVNGPYHAYQGNPILSNANTTEYFQTVGHADLFQDTAGSWWGVALA

TRSGPEFLTYPMGRETVLFPVTWTEGEWPVLSPVRGRMEGWPLPPPDHSIAGTDPFISSPDIVDFEPGSALPL

HFLHWRFPRADAYEISPPGHDYSLRLKPSKLNLTSYDGQNATEDQTLLARRQVDTLFTFSVDVTFSPQQQEEE

AGVSVFLTQNHHIDLGIVLLPLQNDSDTSPTLKPHFRFRATSYVAVPDPVVVPVPDAWLNQSLRLEIKASNVT

HYAFSAGPTAHQSQMMTVAYGAGSLVSWGFTGTLVGVYATTNGGNTTDAYVSRWRYQGQGQFID*

SEQ ID NO: 286
LENGTH: 2138 (including 150 bp 5' UTR and 150 bp 3' UTR)
TYPE: DNA
ORGANISM: M. phaseolina
CGGATATTCAATCCACAGGAACGACAAC

```
GCTCAGTCTGATGGAATTTGGGCGCCGACAATCCGATACCACAAGGGGACTTTCTACATCATCACCATATACA

ACAACCAGGCCCTTGGAAAGGCAACCGGCTTGATTTTCAAGTCGACCGACCCTTACAGCGACTGCAGTTGGAG

CGACCCCATTCGCTATGATGCCAAGACTATTGATCCCGACATCTTCTGGGATGACGATGGCACCGCATATGTT

GCCACTGCCGGCACTAACCTTCAGACTCTTGATACCGAAACCGGTGTTCTCGGTGAACCGCGCGTGATCTGGA

ACGGCACTACCGGCATCTATCTCGAAGGACCGCATCTTTACAAGAAAGACGGCTACTACTACCTGCTGACCGC

AGAAGGCGGCTCCGGCCTGAACCACTCGGTCACCATGGCCCGATCAACGAACATCTGGGGCCCATATGAGAGC

CACCCACACAACCCCGTCCTCACAAACCGCAACACCTCCGCCTACTTCCAAAACATTGGCCACGCCGACCTCT

TCCCCGATGCGAGCGGCAACTGGTGGTCATCCGCCCTCGCCTGGCGCTCCGGCCCCGCCGGCCGCAACTACCC

CATGGGCCGCGAGATGGTGCTTACCACCGTGACCTGGCCCTCCGGCGCGTGGCCCACCTTCGCGCCCGTCCGC

GGCGTGCAATCTGGCTGGCCTCTCCCTCCCTCTCCCTCCCTCCCCGGCGCCGGGCCGCTCACCTCCGCCCCCG

ACGCCTTCGACTTCGCCCCCAACACATCTCTCCCGCGCAACCTCGCGACCTGGGGCTGGCCCGACCCCTCCGC

CTACGCCATCTCGCCCCCCGGCCACCCGCACACCCTGCGCCTGACCCCCTCGCCCGCCAGCATCACGGACGGC

CACGCCAACTACACGGCCGGCTACGACATCGCCAACCGCACGCTCCTCCTGCGGCGGCAGACGCACACGCTCT

TCGAGTTCAGCATCGACCTCTCCTTCGCCCCGACCGCCCTCGACGAAGAGGCCGGCGTCACCGTCTTCCTCAA

CGACGTCCAGAACATCGCGCTCGGCGTCGTCATGCTGCGCGACAACGCGACCGCGACGCTCGCGCCGCACCTC

CGCCTCCTGGCGTCCGGCATCCAGAGCAACGCCGCCGACGACGACGACGCCGTGCCCGCGCCGGTCGTGCTGC

CCATGCCTCGCGCGTGGCGCGGCGATGCGGTGCGGCTGAGCGTGCGCGCCGAGAACGAGACGCACTACGCGTT

CTACGCGGCGGGCAGGGCGCGGCCGGCGGACGCGCGGGCGGTGGCCTGGGTGCCCGCAACCGTGGTGAGCGGC

GGCGTGGGGCCGTTTACCGGTAAGTGGCCTCTTTCGGGCTCTCCCCCTGTGTGTTTTCTGGACTTGTGTGTGT

GGCTGATGATTCCGCTCTAGGCTCTCTGGTCGGGGTGTATGCGACGAGCAATCATGGGAACGGCACCGCGCCG

GCGTACATTTCCAGGTGGAGGTACCACGGTCTCGGTCAGGCGGTTGGGAATGGAGTCATTGTTCCCTCTGACG

CGACTGAGCTCTCTTGATGTAGACAGGAGGTAAGGCGTCCGTGGTTTCTGATGTGGTCCGATGGGAGGAACAG

CACTATTTGCGGGCTCCAGGAGGCGGTGGCTCAGAAGAAAGGGACATGTACTTGTTTAAGGGGTAATACATGT

GTCGTCTGTGGTTTGGGCCTC

SEQ ID NO: 287
LENGTH: 1764
TYPE: DNA
ORGANISM: M. phaseolina
FEATURE NAME/KEY: CDS
LOCATION: (1)...(1764)
atggtactctcgttcaagcttctcttttcttcacttgccacagtgaacgtggcactcagc
 M   V   L   S   F   K   L   L   F   S   S   L   A   T   V   N   V   A   L   S tcggctacacaaaatcagacacgctacaacccagccttaccggctggcacagcgatcca
 S   A   T   Q   N   Q   T   R   Y   N   P   A   L   P   G   W   H   S   D   P agctgcgttttcgtccctgagtgggacaacaccaccttctgcacttcttcgacattacgc
 S   C   V   F   V   P   E   W   D   N   T   T   F   C   T   S   S   T   L   R ctgacgcctggtctccccatttacgtcagccgagatctcacaaactggaaactgatcagc
 L   T   P   G   L   P   I   Y   V   S   R   D   L   T   N   W   K   L   I   S catgctttgtctcggaagagccagtatcctgagtacgaccaatccctggctcagtctgat
 H   A   L   S   R   K   S   Q   Y   P   E   Y   D   Q   S   L   A   Q   S   D ggaatttgggcgccgacaatccgataccacaaggggactttctacatcatcaccatatac
 G   I   W   A   P   T   I   R   Y   H   K   G   T   F   Y   I   I   T   I   Y aacaaccaggcccttggaaaggcaaccggcttgattttcaagtcgaccgaccccttacagc
 N   N   Q   A   L   G   K   A   T   G   L   I   F   K   S   T   D   P   Y   S gactgcagttggagcgaccccattcgctatgatgccaagactattgatcccgacatcttc
 D   C   S   W   S   D   P   I   R   Y   D   A   K   T   I   D   P   D   I   F tgggatgacgatggcaccgcatatgttgccactgccggcactaaccttcagactcttgat
 W   D   D   D   G   T   A   Y   V   A   T   A   G   T   N   L   Q   T   L   D
```

```
accgaaaccggtgttctcggtgaaccgcgcgtgatctggaacggcactaccggcatctat
 T   E   T   G   V   L   G   E   P   R   V   I   W   N   G   T   T   G   I   Y ctcgaaggaccgcatctttacaagaaagacggctactactacctgctgaccgcagaaggc
 L   E   G   P   H   L   Y   K   K   D   G   Y   Y   Y   L   L   T   A   E   G ggctccggcctgaaccactcggtcaccatggcccgatcaacgaacatctggggcccatat
 G   S   G   L   N   H   S   V   T   M   A   R   S   T   N   I   W   G   P   Y gagagccacccacacaaccccgtcctcacaaaccgcaacacctccgcctacttccaaaac
 E   S   H   P   N   P   V   L   T   N   R   N   T   S   A   Y   F   Q   N attggccacgccgacctcttccccgatgcgagcggcaactggtggtcatccgccctcgcc
 I   G   H   A   D   L   F   P   D   A   S   G   N   W   W   S   S   A   L   A tggcgctccggccccgccggccgcaactaccccatgggccgcgagatggtgcttaccacc
 W   R   S   G   P   A   G   R   N   Y   P   M   G   R   E   M   V   L   T   T gtgacctggccctccggcgcgtggcccaccttcgcgcccgtccgcggcgtgcaatctggc
 V   T   W   P   S   G   A   W   P   T   F   A   P   V   R   G   V   Q   S   G tggcctctccctccctctccctcccccggcgccgggccgctcacctccgccccgac
 W   P   L   P   P   S   P   S   L   P   G   A   G   P   L   T   S   A   P   D gccttcgacttcgcccccaacacatctctcccgcgcaacctcgcgacctggggctggccc
 A   F   D   F   A   P   N   T   S   L   P   R   N   L   A   T   W   G   W   P gaccctccgcctacgccatctcgccccccggccacccgcacaccctgcgcctgaccccc
 D   P   S   A   Y   A   I   S   P   P   G   H   P   H   T   L   R   L   T   P tcgcccgccagcatcacggacggccacgccaactacacggccggctacgacatcgccaac
 S   P   A   S   I   T   D   G   H   A   N   Y   T   A   G   Y   D   I   A   N cgcacgctcctcctgcggcggcagacgcacacgctcttcgagttcagcatcgacctctcc
 R   T   L   L   L   R   R   Q   T   H   T   L   F   E   F   S   I   D   L   S ttcgccccgaccgccctcgacgaagaggccggcgtcaccgtcttcctcaacgacgtccag
 F   A   P   T   A   L   D   E   E   A   G   V   T   V   F   L   N   D   V   Q aacatcgcgctcggcgtcgtcatgctgcgcgacaacgcgaccgcgacgctcgcgccgcac
 N   I   A   L   G   V   V   M   L   R   D   N   A   T   A   L   A   P   H ctccgcctcctggcgtccggcatccagagcaacgccgccgacgacgacgacgccgtgccc
 L   R   L   L   A   S   G   I   Q   S   N   A   A   D   D   D   D   A   V   P gcgccggtcgtgctgcccatgcctcgcgcgtggcgcggcgatgcggtgcggctgagcgtg
 A   P   V   V   L   P   M   P   R   A   W   R   G   D   A   V   R   L   S   V cgcgccgagaacgagacgcactacgcgttctacgcggcgggcagggcgcggccggcggac
 R   A   E   N   E   T   H   Y   A   F   Y   A   A   G   R   A   R   P   A   D gcgcgggcggtggcctgggtgcccgcaaccgtggtgagcggcggcgtggggccgtttacc
 A   R   A   V   A   W   V   P   A   T   V   V   S   G   G   V   G   P   F   T ggctctctggtcggggtgtatgcgacgagcaatcatgggaacggcaccgcgccggcgtac
 G   S   L   V   G   V   Y   A   T   S   N   H   G   N   G   T   A   P   A   Y atttccaggtggaggtaccacggtctcggtcaggcggttgggaatggagtcattgttccc
 I   S   R   W   R   Y   H   G   L   G   Q   A   V   G   N   G   V   I   V   P tctgacgcgactgagctctcttga
 S   D   A   T   E   L   S   -

SEQ ID NO: 288
LENGTH: 587
TYPE: PRT
ORGANISM: M. phaseolina
MVLSFKLLFSSLATVNVALSSATQNQTRYNPALPGWHSDPSCVFVPEWDNTTFCTSSTLRLTPGLPIYVSRDL

TNWKLISHALSRKSQYPEYDQSLAQSDGIWAPTIRYHKGTFYIITIYNNQALGKATGLIFKSTDPYSDCSWSD

PIRYDAKTIDPDIFWDDDGTAYVATAGTNLQTLDTETGVLGEPRVIWNGTTGIYLEGPHLYKKDGYYYLLTAE

GGSGLNHSVTMARSTNIWGPYESHPNPVLTNRNTSAYFQNIGHADLFPDASGNWWSSALAWRSGPAGRNYPM

GREMVLTTVTWPSGAWPTFAPVRGVQSGWPLPPSPSLPGAGPLTSAPDAFDFAPNTSLPRNLATWGWPDPSAY

AISPPGHPHTLRLTPSPASITDGHANYTAGYDIANRTLLLRRQTHTLFEFSIDLSFAPTALDEEAGVTVFLND

VQNIALGVVMLRDNATATLAPHLRLLASGIQSNAADDDDAVPAPVVLPMPRAWRGDAVRLSVRAENETHYAFY
```

-continued

AAGRARPADARAVAWVPATVVSGGVGPFTGSLVGVYATSNHGNGTAPAYISRWRYHGLGQAVGNGVIVPSDAT

ELS*

SEQ ID NO: 289
LENGTH: 2195 (including 150 bp 5' UTR and 150 bp 3' UTR)
TYPE: DNA
ORGANISM: M. phaseolina
GATGCATGCCGCAATTGGAGCACACAAACGCGAAAGTGGGGCAGGAAGTGAGGGGTCAATCATCAAGCTCTAC

TTTGCCCGAATCCAAAAACCTTAAAACCGCACGCTGCAACCTTGCCAAAGCACGACGCAAATCCCACCGTCTC

CACCATGGGAATCTACAACAACCCTATCATCCCCGGTTTCAACCCGGACCCGTCAATCGTACGGGTGGGGCCC

GACTACTTCCTTGTCACCTCCACGTTTGAATATTTCCCAGGCGTCCCAATTTACCACAGCAAAGACCTAATCT

ACTGGAAGCTGATAGGCCACGCCCTGACGCGCCGCTCTCAGCTCGACATCCGCACCCCCGAGACCGGCGGCGG

TATCTGGGCGCCGACCATCCGATGGCACGACGGCGTCTTCTACGTCACTACAGCATGCTTTGACAGATACAGA

CCGCAAGCCGATGACCGCGTGTGGCCGCGCGGCTTCTACGTCAAAACGGCCAATGTCTGGGACGAGACGAGCT

GGTCGGAGCCGGTGTACTTCGACCAGGTGGGGTTTGACCAGGACGTGCGTGACTCCCCTCTCTAAGCCGCCAT

CTCCTTTTGCCCCTCAAAGATCATATACCAAAGCAATTGTAAATGCAAAAAAAAAAAAAAAAGATCAGCCAA

AAACAAACGGCCAAGACTGTCACCCAGGCACACTAACGCATCGAACCACAGCTCTTCTGGGACACCGACGGTA

CGACCTACCTCTCCACCACCTACCGCAAATCGCCGCGCACCCCCGTCCCACCCAACTCTCCCCCCCTCAAGGA

TTTTGCCATCCACATCTCGACCGTCGATCTGCGCACCGGCGCCGCGACGTCGCCTCCGCGCCTCGTCCGCGCC

TCGTCCGTCGGCAGCGGCGTCGCGGAGGGGTCGCATCTGTTCAAGAGGGGGGCGTGGTACTACCTCTTCACGG

CCGAGGGCGGGACCGAGGGCGGCCACAGCGAGGTCATGTCGAGGAGCCACGAGGGCCCGTTCGGGCCATGGGA

GGTGTGTCCGCGGGGCCCGGTATTGGGCGGAGGGCAGGGAGAGGTAAGGCAGACGGGGCATGCGGATTTGGTG

GAGGGGGTGGACGGGAGGTGGTGGGCGGTGTTTTTGGGGGTGAGGAGAAGGGCGGGGGAAACGGGTGGGGATT

GGGTGGGGAGCGTGTTTGGTGAGTTGTCTGCTTTTCCTTTTCTGGGAGGTGCGGAAGCTGATCCTGATGAAAG

GGAGAGAGACGTTTCTTGTACCAGTGACGTGGGAGAACGATTGGCCGGTATTTAATGCGGGCAGGAGTGTTGA

GCTTCTGGGAGAAGCGCCGGGGCTGTTCCAGGTTGAGCAAACGGCAGCGTGGAGAGATGATTTTGAGGCGGAG

GAGATGCAGCTGGGATGGTACAGGAAGAGTAAGAGCCAGGAGCAAGCTGACAGTTTGCATTTTTTTTTTTT

GGCTGATGGACATCAACAGATACACCGGTGAAGCAGGACTTCTCTTTGACGGAGCGCCCGGGATATCTGCGTC

TGTATGGTGGCCCCTACACACTCTCTACGCCTGCTTGCCCAACCCTGTTCCTCCGCAAGCAGAGACACGATCC

GGTGAGATGGAAGACGCGGCTTTCGTTCCATCCCAGCTCGCCAAACACAGAAGCTGGGTCCCTTGTATACTGG

AATCAGCATACGTACTCGAGCATTGGCATCCGGATGGCTCCCGACGGCAGCCAAGGCTGTGCAAGAATACTGC

GATTTCGGCCTGCGGGAGGGAATGTGGTGGACATGCCATTGAGATCTACGGAGTCAGATGTTGTGCTCGCAAT

CAAGTCAGACAACGGATATTCGTTTGGGTATAGAGAGGTAGTCGGCGGGACGGATGACGAAGAAGTAGTTTGG

ATCGGCCAAGTGAGCGCTATGGCGATGACTCAGGACCCACAGGTTGGCGCATCATTCACAGGGATGATGTTTG

GAGTATTTGCTTTTGGAGAGATGGAAAAGTGCTTTACCCCGGCAGACTTCCTGTATGCCGAGTTTCAGTCCTA

AAGTGTAGAATTATGCGGATCTGCTGGGCCGGTAATCCCAAGACGAAGCATCAATCAACTTCTGGCCGTCAGC

ATTTTCGTCAAGGAATAGATGGAAAATGTTAGACATATAAGGAATCCTAGCCAAATGCGAAGCTGGAGCAATA

TCCGT

SEQ ID NO: 290
LENGTH: 1623
TYPE: DNA
ORGANISM: M. phaseolina
FEATURE NAME/KEY: CDS
LOCATION: (1)...(1623)
atgggaatctacaacaaccctatcatccccggtttcaacccggacccgtcaatcgtacgg
 M  G  I  Y  N  N  P  I  I  P  G  F  N  P  D  P  S  I  V  R gtggggcccgactacttccttgtcacctccacgtttgaatatttcccaggcgtcccaatt
 V  G  P  D  Y  F  L  V  T  S  T  F  E  Y  F  P  G  V  P  I -continued

```
taccacagcaaagacctaatctactggaagctgataggcacgccctgacgcgccgctct
 Y  H  S  K  D  L  I  Y  W  K  L  I  G  H  A  L  T  R  R  S cagctcgacatccgcacccccgagaccggcggcggtatctgggcgccgaccatccgatgg
 Q  L  D  I  R  T  P  E  T  G  G  G  I  W  A  P  T  I  R  W cacgacggcgtcttctacgtcactacagcatgctttgacagatacagaccgcaagccgat
 H  D  G  V  F  Y  V  T  T  A  C  F  D  R  Y  R  P  Q  A  D gaccgcgtgtggccgcgcggcttctacgtcaaaacggccaatgtctgggacgagacgagc
 D  R  V  W  P  R  G  F  Y  V  K  T  A  N  V  W  D  E  T  S tggtcggagccggtgtacttcgaccaggtggggtttgaccaggaccttctctgggacacc
 W  S  E  P  V  Y  F  D  Q  V  G  F  D  Q  D  L  F  W  D  T gacggtacgacctacctctccaccacctaccgcaaatcgccgcgcacccccgtcccaccc
 D  G  T  T  Y  L  S  T  T  Y  R  K  S  P  R  T  P  V  P  P aactctccccccctcaaggattttgccatccacatctcgaccgtcgatctgcgcaccggc
 N  S  P  P  L  K  D  F  A  I  H  I  S  T  V  D  L  R  T  G gccgcgacgtcgcctccgcgcctcgtccgcgcctcgtccgtcggcagcggcgtcgcggag
 A  A  T  S  P  P  R  L  V  R  A  S  S  V  G  S  G  V  A  E gggtcgcatctgttcaagagggggcgtggtactacctcttcacggccgagggcgggacc
 G  S  H  L  F  K  R  G  A  W  Y  Y  L  F  T  A  E  G  G  T gagggcggccacagcgaggtcatgtcgaggagccacgagggcccgttcgggccatgggag
 E  G  G  H  S  E  V  M  S  R  S  H  E  G  P  F  G  P  W  E gtgtgtccgcggggcccggtattgggcggagggcagggagaggtaaggcagacggggcat
 V  C  P  R  G  P  V  L  G  G  G  Q  G  E  V  R  Q  T  G  H gcggatttggtggaggggtggacgggaggtggtgggcggtgttttgggggtgaggaga
 A  D  L  V  E  G  V  D  G  R  W  W  A  V  F  L  G  V  R  R agggcggggaaacgggtgggattgggtggggagcgtgtttgggagagagacgtttctt
 R  A  G  E  T  G  G  D  W  V  G  S  V  F  G  R  E  T  F  L gtaccagtgacgtgggagaacgattggccggtatttaatgcgggcaggagtgttgagctt
 V  P  V  T  W  E  N  D  W  P  V  F  N  A  G  R  S  V  E  L ctgggagaagcgccggggctgttccaggttgagcaaacggcagcgtggagagatgattt
 L  G  E  A  P  G  L  F  Q  V  E  Q  T  A  A  W  R  D  D  F gaggcggaggagatgcagctgggatggtacaggaagaatacaccggtgaagcaggacttc
 E  A  E  E  M  Q  L  G  W  Y  R  K  N  T  P  V  K  Q  D  F tctttgacggagcgcccgggatatctgcgtctgtatggtggcccctacacactctctacg
 S  L  T  E  R  P  G  Y  L  R  L  Y  G  G  P  Y  T  L  S  T cctgcttgcccaaccctgttcctccgcaagcagagacacgatccggtgagatggaagacg
 P  A  C  P  T  L  F  L  R  K  Q  R  H  D  P  V  R  W  K  T cggctttcgttccatcccagctcgccaaacacagaagctgggtcccttgtatactggaat
 R  L  S  F  H  P  S  S  P  N  T  E  A  G  S  L  V  Y  W  N cagcatacgtactcgagcattggcatccggatggctcccgacggcagccaaggctgtgca
 Q  H  T  Y  S  S  I  G  I  R  M  A  P  D  G  S  Q  G  C  A agaatactgcgatttcggcctgcgggagggaatgtggtggacatgccattgagatctacg
 R  I  L  R  F  R  P  A  G  G  N  V  V  D  M  P  L  R  S  T gagtcagatgttgtgctcgcaatcaagtcagacaacggatattcgtttgggtatagagag
 E  S  D  V  V  L  A  I  K  S  D  N  G  Y  S  F  G  Y  R  E gtagtcggcgggacggatgacgaagaagtagtttggatcggccaagtgagcgctatggcg
 V  V  G  G  T  D  D  E  E  V  V  W  I  G  Q  V  S  A  M  A atgactcaggacccacaggttggcgcatcattcacagggatgatgtttggagtatttgct
 M  T  Q  D  P  Q  V  G  A  S  F  T  G  M  M  F  G  V  F  A tttggagagatggaaaagtgctttaccccggcagacttcctgtatgccgagtttcagtcc
 F  G  E  M  E  K  C  F  T  P  A  D  F  L  Y  A  E  F  Q  S taa
 -
```

SEQ ID NO: 291
LENGTH: 540
TYPE: PRT
ORGANISM: M. phaseolina

MGIYNNPIIPGFNPDPSIVRVGPDYFLVTSTFEYFPGVPIYHSKDLIYWKLIGHALTRRSQLDIRTPETGGGI

WAPTIRWHDGVFYVTTACFDRYRPQADDRVWPRGFYVKTANVWDETSWSEPVYFDQVGFDQDLFWDTDGTTYL

STTYRKSPRTPVPPNSPPLKDFAIHISTVDLRTGAATSPPRLVRASSVGSGVAEGSHLFKRGAWYYLFTAEGG

TEGGHSEVMSRSHEGPFGPWEVCPRGPVLGGGQGEVRQTGHADLVEGVDGRWWAVFLGVRRRAGETGGDWVGS

VFGRETFLVPVTWENDWPVFNAGRSVELLGEAPGLFQVEQTAAWRDDFEAEEMQLGWYRKNTPVKQDFSLTER

PGYLRLYGGPYTLSTPACPTLFLRKQRHDPVRWKTRLSFHPSSPNTEAGSLVYWNQHTYSSIGIRMAPDGSQG

CARILRFRPAGGNVVDMPLRSTESDVVLAIKSDNGYSFGYREVVGGTDDEEVVWIGQVSAMAMTQDPQVGASF

TGMMFGVFAFGEMEKCFTPADFLYAEFQS*

SEQ ID NO: 292
LENGTH: 1517 (including 150 bp 5' UTR and 150 bp 3' UTR)
TYPE: DNA
ORGANISM: M. phaseolina

GTAACTAGAAAGCTAAATGCAGGTAACCTTTCTGTACACTTCATTGCCAGTAATCGATATAAATTCTGTGCAG

CGCGTTTCTTTGGCAAGCAATCCTTTCGAGGGACGAACCACTCATTCGTTCATTCATTCCATCGCTTGCGCCC

GGCAATGCTGAAGCTGGTATTTCTCGTTCTTGCCCTTCTGCACACGGCAGCATGGGCACAGTCAACCTATCCT

CCCCCGATGCAGTGCCGAGGCGGTTGTACCAACGTGCACGATGGCTCGTTGATTCAGCGTGACGATGGGAAAT

GGTTCCGCTTCGCTGGTTCCTGGGGCATGTCCATCTTCACTTCCGATGACTTCCTCGGTCCCTGGGATTCTGT

GGGAACTGCATTAGACAACAATACCGACAGATGGGTATAGCTGCTCCCTTTTCTTTTCCATTGTCGCCACCAT

CCCGGTACAATGCAAAGAAAATCCAAGAAAGACGAAAAACATAAACTATCCCTTCTCCGCACCTCCACCCCAC

CCTCCACCTCCTCGCTAAAATATACACCCGCGATAGGCGCCCGACGTCCACAAAGTCGGCAATCTCTACTATC

TCTACTACTCCATCAGCACCTGGGGCACGCAGAACTCTCACATCGGCGTCGCCACCTCGCCCTCGCTCGAGCC

GGGCACGTGGACCGACCTGGGCAGCACGGGCGTCGCATCGCGCGACGGCTCGCGCTACAACGCCATCGACGGC

AACCTCTTCCAGGACGGCGACGGCAGCTTCCTGCTCACCTTCGGATCCTTCTGGGGCAACACCTACCAAGTAC

CGCTGACGTCGCCCGAGCCCACCCGCGCGAACGGCAATCCGTACAACATCCAGTTCAACTCGACCGGCAGCCA

ATCGTCCGAGGGGCCGTATCTGTTCAAGTTTGGCGAATGGTATTATCTATTCTGGTCGAGCGGGCAGTGCTGC

AAGTACGATACGGAGCGCCCGAGGCAGGGCGAGGAGTACAAGATTATGGTGTGTCGGGCGGAGCGCGCGAGCG

GGCCGTTTGTAGGTTTTTTTTTTTTTCCACTTCCCCTGTTAAAACTTTTTTTGTGGCGTATCCGCGGAAGGA

ACTTAGGACTTTGGAGCGGCATGGCTGAAGTTTCCCTGAAACAGGTCGACATGGACAATACGCCTTGCACGCA

GAACGGCGGACGCAGGTGCTCGGCAGCCACGATTTCGTGTACGGGCCGGGCGGGCAGGGGCTTTACCACATT

CCGAACTATGGCCCGGTGATATATTATCATTATGTTGATACCAAGGTCGGGTTCGCGGATGGGCAGAAGCGGA

TTGGGATTAACAAGGTGGATTTTGTGACGGGGTGGCCGGTGTTGGTGGGCTAATGAGGCGGCTTTGCCCATTT

CGTTTGTCCCTTTTCCCACCAGTACTACTGACTTCTTTGTCCAGTGCTCTGTAACATTCCTGAAGTATAGCTA

TTTCAGCGACGATTCCTAACAGTAGACTGTCCTTTGGACGCATGGAGTTCAGGGATA

SEQ ID NO: 293
LENGTH: 960
TYPE: DNA
ORGANISM: M. phaseolina
FEATURE NAME/KEY: CDS
LOCATION: (1)...(960)

```
atgctgaagctggtatttctcgttcttgcccttctgcacacggcagcatgggcacagtca
 M   L   K   L   V   F   L   V   L   A   L   L   H   T   A   A   W   A   Q   S acctatcctcccccgatgcagtgccgaggcggttgtaccaacgtgcacgatggctcgttg
 T   Y   P   P   P   M   Q   C   R   G   G   C   T   N   V   H   D   G   S   L attcagcgtgacgatgggaaatggttccgcttcgctggttcctggggcatgtccatcttc
 I   Q   R   D   D   G   K   W   F   R   F   A   G   S   W   G   M   S   I   F
```

```
acttccgatgacttcctcggtccctgggattctgtgggaactgcattagacaacaatacc
 T  S  D  D  F  L  G  P  W  D  S  V  G  T  A  L  D  N  N  T gacagatgggcgcccgacgtccacaaagtcggcaatctctactatctctactactccatc
 D  R  W  A  P  D  V  H  K  V  G  N  L  Y  Y  L  Y  Y  S  I agcacctggggcacgcagaactctcacatcggcgtcgccacctcgcctcgctcgagccg
 S  T  W  G  T  Q  N  S  H  I  G  V  A  T  S  P  S  L  E  P ggcacgtggaccgacctgggcagcacgggcgtcgcatcgcgcgacggctcgcgctacaac
 G  T  W  T  D  L  G  S  T  G  V  A  S  R  D  G  S  R  Y  N gccatcgacggcaacctcttccaggacggcgacggcagcttcctgctcaccttcggatcc
 A  I  D  G  N  L  F  Q  D  G  D  G  S  F  L  L  T  F  G  S ttctggggcaacacctaccaagtaccgctgacgtcgcccgagcccacccgcgcgaacggc
 F  W  G  N  T  Y  Q  V  P  L  T  S  P  E  P  T  R  A  N  G aatccgtacaacatccagttcaactcgaccggcagccaatcgtccgaggggccgtatctg
 N  P  Y  N  I  Q  F  N  S  T  G  S  Q  S  S  E  G  P  Y  L ttcaagtttggcgaatggtattatctattctggtcgagcgggcagtgctgcaagtacgat
 F  K  F  G  E  W  Y  Y  L  F  W  S  S  G  Q  C  C  K  Y  D acggagcgcccgaggcagggcgaggagtacaagattatggtgtgtcgggcggagcgcgcg
 T  E  R  P  R  Q  G  E  E  Y  K  I  M  V  C  R  A  E  R  A agcgggccgtttgtcgacatggacaatacgccttgcacgcagaacggcgggacgcaggtg
 S  G  P  F  V  D  M  D  N  T  P  C  T  Q  N  G  G  T  Q  V ctcggcagccacgatttcgtgtacgggccgggcgggcaggggctttaccacattccgaac
 L  G  S  H  D  F  V  Y  G  P  G  G  Q  G  L  Y  H  I  P  N tatggcccggtgatatattatcattatgttgataccaaggtcgggttcgcggatgggcag
 Y  G  P  V  I  Y  Y  H  Y  V  D  T  K  V  G  F  A  D  G  Q aagcggattgggattaacaaggtggattttgtgacggggtggccggtgttggtgggctaa
 K  R  I  G  I  N  K  V  D  F  V  T  G  W  P  V  L  V  G  -

SEQ ID NO: 294
LENGTH: 319
TYPE: PRT
ORGANISM: M. phaseolina
MLKLVFLVLALLHTAAWAQSTYPPPMQCRGGCTNVHDGSLIQRDDGKWFRFAGSWGMSIFTSDDFLGPWDSVG

TALDNNTDRWAPDVHKVGNLYYLYYSISTWGTQNSHIGVATSPSLEPGTWTDLGSTGVASRDGSRYNAIDGNL

FQDGDGSFLLTFGSFWGNTYQVPLTSPEPTRANGNPYNIQFNSTGSQSSEGPYLFKFGEWYYLFWSSGQCCKY

DTERPRQGEEYKIMVCRAERASGPFVDMDNTPCTQNGGTQVLGSHDFVYGPGGQGLYHIPNYGPVIYYHYVDT

KVGFADGQKRIGINKVDFVTGWPVLVG*

SEQ ID NO: 295
LENGTH: 1578 (including 150 bp 5' UTR and 150 bp 3' UTR)
TYPE: DNA
ORGANISM: M. phaseolina
CCTTATAAGCTGCTGCTGTCCTCCGTGATCATGTCTCTCATTCCAGAGCCCCATCTCCACACTCCCTTGCGCT

CCGCGTATATATCTCCCTTCCCTTCTTGACTCATAAATTTGTTTGCCAGCCATCCGCGCATTGCATATATCCC

CACGATGCTGTCCTCCCTGGCCGCCCTCGGTGCAACCGCACTGCTGTCTATAGCCCCACTGGTCAAGGCCCTT

CCCCTTGAGAAGCGGGTTGTAAATGGTCCTGTCATTTCTTCCAACTTCCCCGACCCTTCCATCATTCGCGTCG

GCAACACTTGGTACTCCTTCGGCACAAACAGCGCAGACAACGGCGGCGTGCATGTCCAGATTGCCAAATCTGA

CGATTTCAGCTCATGGACCGTGTTGGGCAAGGATGCACTTCCGAACTTGCCCGGATGGGTTTACACTGCAAAC

CCCGCCGTCTGGGCTCCCGATGTCATCCAGAACGTATGCATGCTCACATCATCCCTGCACCCGGAAGAGGAAG

CACTGCTGACACAGCTGCCTTTTCAGGATGCGGGCAAATTTGTGCTTTACTTTTCTGCCTCTCGCAACGACAA

GCTGCACTGCACTGGTGTCGCTATTGCTGACACCATCGAGGGTCCCTACACTGCCCGCCCTGACCCCTGGGCT

TGTCCTCTCGACCAAGGCGGCGCCATTGACGCCTCAAGCTTCCGCGACTCGGATGGCACCCGCTACGTGACTT

ACAAAATTGATGTAAGCGCTCCGGCATGATCTCACTTCAGCCTCGGCCCTCATTCGCGCGAATCAAAATTCAT

GCTGACTGAATTTCCCAACAGGGCAATGCCCTCGGCGGCGGTGGTGTTTGCGGCAACACTGAGCCCCCGATCA
```

-continued

```
GGTCAACTCCCATCATGCAGCAAAAGGTCGCCGGCAACGGTATTGACAAGATCGGTGACGCTTACCAAGTATT

GGACCGCTCAGACGCAGACGGCCCGCTGGTTGAAGCCCCAGCATCGCGAAGCTGCCCAACGGTCATTATGTG

TTATTTTTCAGCTCAAACTGCTTCTACACGATCGACTACGACGTGACATACGCCATTGCACCCAGTAAGTACC

CACACAGCCCACTTCTTTCTCTTTCAAATATCGGCACTATCCGGTCTGTACCGTCCGGCACGGTACGATCGGA

TCCACGTTGGCGGCCTGATGATCAAAGACTTACACGCGCATTCATTAACCATGGCAGGCGTCTCCGGCCCTTA

TACCAAGTCCGGCCCGCTGTTTGTCTCGCAGGGCAAGCACGGTTTCTGGTCGCCCGGTGGAGCCAGCATCTCG

CCCGACGCGAAGCACCTCGTCTTCCATTCCTACAACCCCGGCGGTTCCAACACCCGCGCCATGTACACGTCAA

CCCTCACCTGGCACGGCGACGTCCCGAACTCGGAGGCATAAGCTGAAGAGCGGAGCAAGAGAACATAAAGACC

ATCACGCCTCTTTACGAATTTTCTTTCTGCATTGTCCATTCGACATCGTCAAGCCGGCGATCATCCGTTCAAG

ACTACGTACAGAAGCAGTGCAGATGCACTGCTTCGGCCCCGCTTT
```

SEQ ID NO: 296
LENGTH: 1056
TYPE: DNA
ORGANISM: M. phaseolina
FEATURE NAME/KEY: CDS
LOCATION: (1)...(1056)

```
atgctgtcctccctggccgccctcggtgcaaccgcactgctgtctatagccccactggtc
 M   L   S   S   L   A   A   L   G   A   T   A   L   L   S   I   A   P   L   V aaggcccttccccttgagaagcgggttgtaaatggtcctgtcatttcttccaacttcccc
 K   A   L   P   L   E   K   R   V   V   N   G   P   V   I   S   S   N   F   P gacccttccatcattcgcgtcggcaacacttggtactccttcggcacaaacagcgcagac
 D   P   S   I   I   R   V   G   N   T   W   Y   S   F   G   T   N   S   A   D aacggcggcgtgcatgtccagattgccaaatctgacgatttcagctcatggaccgtgttg
 N   G   G   V   H   V   Q   I   A   K   S   D   D   F   S   S   W   T   V   L ggcaaggatgcacttccgaacttgcccggatgggtttacactgcaaaccccgccgtctgg
 G   K   D   A   L   P   N   L   P   G   W   V   Y   T   A   N   P   A   V   W gctcccgatgtcatccagaacgtatgcatgctcacatcatccctgcacccggaagaggaa
 A   P   D   V   I   Q   N   V   C   M   L   T   S   S   L   H   P   E   E   E gcactgctgacacagctgccttttcaggatgcgggcaaatttgtgctttacttttctgcc
 A   L   L   T   Q   L   P   F   Q   D   A   G   K   F   V   L   Y   F   S   A tctcgcaacgacaagctgcactgcactggtgtcgctattgctgacaccatcgagggtccc
 S   R   N   D   K   L   H   C   T   G   V   A   I   A   D   T   I   E   G   P tacactgcccgccctgaccctgggcttgtcctctcgaccaaggcggcgccattgacgcc
 Y   T   A   R   P   D   P   W   A   C   P   L   D   Q   G   G   A   I   D   A tcaagcttccgcgactcggatggcacccgctacgtgacttacaaaattgatggcaatgcc
 S   S   F   R   D   S   D   G   T   R   Y   V   T   Y   K   I   D   G   N   A ctcggcggcggtggtgtttgcggcaacactgagcccccgatcaggtcaactcccatcatg
 L   G   G   G   V   C   G   N   T   E   P   P   I   R   S   T   P   I   M cagcaaaaggtcgccggcaacggtattgacaagatcggtgacgcttaccaagtattggac
 Q   Q   K   V   A   G   N   G   I   D   K   I   G   D   A   Y   Q   V   L   D cgctcagacgcagacggcccgctggttgaagccccagcatcgcgaagctgcccaacggt
 R   S   D   A   D   G   P   L   V   E   A   P   S   I   A   K   L   P   N   G cattatgtgttattttcagctcaaactgcttctacacgatcgactacgacgtgacatac
 H   Y   V   L   F   F   S   S   N   C   F   Y   T   I   D   Y   D   V   T   Y gccattgcacccagcgtctccggcccttataccaagtccggcccgctgtttgtctcgcag
 A   I   A   P   S   V   S   G   P   Y   T   K   S   G   P   L   F   V   S   Q ggcaagcacggtttctggtcgcccggtggagccagcatctcgcccgacgcgaagcacctc
 G   K   H   G   F   W   S   P   G   G   A   S   I   S   P   D   A   K   H   L gtcttccattcctacaaccccggcggttccaacacccgcgccatgtacacgtcaaccctc
 V   F   H   S   Y   N   P   G   G   S   N   T   R   A   M   Y   T   S   T   L acctggcacggcgacgtcccgaactcggaggcataa
 T   W   H   G   D   V   P   N   S   E   A   -
```

SEQ ID NO: 297
LENGTH: 351
TYPE: PRT
ORGANISM: M. phaseolina
MLSSLAALGATALLSIAPLVKALPLEKRVVNGPVISSNFPDPSIIRVGNTWYSFGTNSADNGGVHVQIAKSDD

FSSWTVLGKDALPNLPGWVYTANPAVWAPDVIQNVCMLTSSLHPEEEALLTQLPFQDAGKFVLYFSASRNDKL

HCTGVAIADTIEGPYTARPDPWACPLDQGGAIDASSFRDSDGTRYVTYKIDGNALGGGGVCGNTEPPIRSTPI

MQQKVAGNGIDKIGDAYQVLDRSDADGPLVEAPSIAKLPNGHYVLFFSSNCFYTIDYDVTYAIAPSVSGPYTK

SGPLFVSQGKHGFWSPGGASISPDAKHLVFHSYNPGGSNTRAMYTSTLTWHGDVPNSEA*

SEQ ID NO: 298
LENGTH: 1442 (including 150 bp 5' UTR and 150 bp 3' UTR)
TYPE: DNA
ORGANISM: M. phaseolina
TTTCAAGCCAGTACCATGGCGCATCGTTACAAGTCAGGCGTATCCTCAAACTGGATCTATCTTGTCTATATAT

GCCGTATCAATGTCGAAAAGGCCTTTTGAGAAAGTCCACGCCGCTTCTACTTCGACTTCGTGCATCCAGCCCC

AGCGATGCTGTGCTACCCCTGCGCGCTGCTATCAATAGCCACGGCGGTTGCTGCCAGCTCAACCCCCAAGCTT

GCGCTCAACTCGGTCATCAGGTCCGATTTTCCGGATCCCTCACTCCTCCAGGATGGTGATATGTGGTATTCTT

TTGGCACCAACCAAAACCGGGATATCCATGTGCAGATCGCCACATCGTCCGACTTTGATACCTGGGCGGTGAT

TTCTGGCACGGACGCACTCCCAAACTTGCCTGGATGGGTGAATCCGCTCGACCCGGCCGTATGGGCACCTGAT

GTAATAAAGAACGTACGCCTCCTCCGAATAACCCCGTGTGGAACCTGGTCGCTACTGACATTTCTGCCTGGAG

GACGATGGCAAATACGTGCTTTACTTTAGCGCCGCCAAGATCGATGCTGCCAGGCATTGCATAGGAGTAGCGA

CGTCCGACAATGTTGAAGGCCCGTACACTGCTCAAGACGAGCCGTGGGTTTGTCATCTGGAGCAGGGCGGCGC

TATCGATGCTTCAAGCTTCCGGGACTCCGACGGGTCTCGCTACGTCACATATAAGATCGACGTGCGTGAATGG

TTTCGGGCTTTTCTTCAGTCGGCGTTTtCTTTTTTTTGAGCTGACCAGATGGCAGGGAAACTCGCTCAATACC

CGTGATGGCTCTTGCGGCGGGGCACGGCCATACAATCCAACCCCGATCATGCAGCAGCAAGTTAGCGCCAATG

GTATCGACAAGATTGGCGATCCGATCGTGCTTCTGGATCGTGAGGAGCCTGACGGGCCCCTCATCGAAGCCCC

CAGCATCGCGAAGCTCCCTGACGGGCGCTACGTCTTGTTTTTCAGCTCCAACTGCTGGCAATTTGACTACGAT

TTGAGTTACGCGCTTGCGGACAGTGAGTAGCACTCCGCACATGTTGGACACAAATCATGAGCTGAACTCATTG

CGACAGGCGTGAGGGGTCCGTATACAAAGTCGGGGCACTGTTCACTAGCACGGGAAGCGGTTTGGACAACCC

TGGAGGTGCGAGCATAGCCGCCGATGGTATCCACCTGGTCTTTCATGCCTTCGTCGCCGAAAAGACCCGCGGC

GTATATTCTACCTCGGTTGCTTTCAATGGCGACGAGGTAACGACAGGCTAAGGAGAGCGCTCATTGCGGTGTA

CGTTTGGTATGGGTGTGGGGTTGATTCCGCGCATAGCGCGGTTGCCGCGATTCTGAAATTGTGTGTTACATCT

TCAATGTAAATACAACTTTGCTCAACCTCATTTTCACGGTTCCGTTTATTGTTGG

SEQ ID NO: 299
LENGTH: 957
TYPE: DNA
ORGANISM: M. phaseolina
FEATURE NAME/KEY: CDS
LOCATION: (1)...(957)
atgctgtgctacccctgcgcgctgctatcaatagccacggcggttgctgccagctcaacc
 M  L  C  Y  P  C  A  L  L  S  I  A  T  A  V  A  A  S  S  T cccaagcttgcgctcaactcggtcatcaggtccgattttccggatccctcactcctccag
 P  K  L  A  L  N  S  V  I  R  S  D  F  P  D  P  S  L  L  Q gatggtgatatgtggtattcttttggcaccaaccaaaaccgggatatccatgtgcagatc
 D  G  D  M  W  Y  S  F  G  T  N  Q  N  R  D  I  H  V  Q  I gccacatcgtccgactttgatacctgggcggtgatttctggcacggacgcactcccaaac
 A  T  S  S  D  F  D  T  W  A  V  I  S  G  T  D  A  L  P  N ttgcctggatgggtgaatccgctcgacccggccgtatgggcacctgatgtaataaagaac
 L  P  G  W  V  N  P  L  D  P  A  V  W  A  P  D  V  I  K  N gacgatggcaaatacgtgctttactttagcgccgccaagatcgatgctgccaggcattgc
 D  D  G  K  Y  V  L  Y  F  S  A  A  K  I  D  A  A  R  H  C

```
ataggagtagcgacgtccgacaatgttgaaggcccgtacactgctcaagacgagccgtgg
 I  G  V  A  T  S  D  N  V  E  G  P  Y  T  A  Q  D  E  P  W gtttgtcatctggagcagggcggcgctatcgatgcttcaagcttccgggactccgacggg
 V  C  H  L  E  Q  G  G  A  I  D  A  S  S  F  R  D  S  D  G tctcgctacgtcacatataagatcgacggaaactcgctcaatacccgtgatggctcttgc
 S  R  Y  V  T  Y  K  I  D  G  N  S  L  N  T  R  D  G  S  C ggcggggcacggccatacaatccaaccccgatcatgcagcagcaagttagcgccaatggt
 G  G  A  R  P  Y  N  P  T  P  I  M  Q  Q  Q  V  S  A  N  G atcgacaagattggcgatccgatcgtgcttctggatcgtgaggagcctgacgggcccctc
 I  D  K  I  G  D  P  I  V  L  L  D  R  E  E  P  D  G  P  L atcgaagcccccagcatcgcgaagctccctgacgggcgctacgtcttgttttcagctcc
 I  E  A  P  S  I  A  K  L  P  D  G  R  Y  V  L  F  F  S  S aactgctggcaatttgactacgatttgagttacgcgcttgcggacagcgtgaggggtccg
 N  C  W  Q  F  D  Y  D  L  S  Y  A  L  A  D  S  V  R  G  P tatacaaagtcggggccactgttcactagcacgggaagcggtttggacaaccctggaggt
 Y  T  K  S  G  P  L  F  T  S  T  G  S  G  L  D  N  P  G  G gcgagcatagccgccgatggtatccacctggtctttcatgccttcgtcgccgaaaagacc
 A  S  I  A  A  D  G  I  H  L  V  F  H  A  F  V  A  E  K  T cgcggcgtatattctacctcggttgctttcaatggcgacgaggtaacgacaggctaa
 R  G  V  Y  S  T  S  V  A  F  N  G  D  E  V  T  T  G  -

SEQ ID NO: 300
LENGTH: 318
TYPE: PRT
ORGANISM: M. phaseolina
MLCYPCALLSIATAVAASSTPKLALNSVIRSDFPDPSLLQDGDMWYSFGTNQNRDIHVQIATSSDFDTWAVIS

GTDALPNLPGWVNPLDPAVWAPDVIKNDDGKYVLYFSAAKIDAARHCIGVATSDNVEGPYTAQDEPWVCHLEQ

GGAIDASSFRDSDGSRYVTYKIDGNSLNTRDGSCGGARPYNPTPIMQQQVSANGIDKIGDPIVLLDREEPDGP

LIEAPSIAKLPDGRYVLFFSSNCWQFDYDLSYALADSVRGPYTKSGPLFTSTGSGLDNPGGASIAADGIHLVF

HAFVAEKTRGVYSTSVAFNGDEVTTG*

SEQ ID NO: 301
LENGTH: 1410 (including 150 bp 5' UTR and 150 bp 3' UTR)
TYPE: DNA
ORGANISM: M. phaseolina
TCGAGAAGCCTTCGAGCAGGTTTCTAAGCCTTCGACCATAAGTACAGCACTTCCCGGAGCACCAGACCGGTCA

TCACAGCCCAACAGCTTCCAACTGCCCAACAAAGCCTCCCCAAGCCACACTACAGGCTCAGTCATTCGTTTCC

AATGATGTTCTACACTCGTTTCGCCGCGGCGGCCCTGCTGTCCGCCTCCGCCCTCACCGAGGCGGCTCCTACC

AACATGACCGCCGGCGGCTTCAAGCCACCGCACTTCAAGACCCAACGGGTCGTCGACACCGAATTCGCCGACC

CGGGCATCCTCAAGGTCGGCGACACCTGGTACGCCTTCGCGACCAACAACGGCAAATCCAACGTCCGCGTTGC

CACCTCGACCGACTTCGAACACTGGACCGTCAAGGAGAAGTGGGACGCGCTGCCGCTCACCGGCGCGTGGACC

GCGCAGCCCAAGATGCAGACGGAGAAGCTGCTGCCCACGTCCGACAAGTTCCTCGACAGCGTCGGCGGGCTCC

TCGAGGGCCGGTGGCCGTGGTCCAACGCGCCGCCCGCCGTCTGGGCGCCCGACGCCGTGACCAACGACGACGG

CATGCACGTGCTCTACTACTCGGCGCAGCAGCGCGGCCAGAAGCGGCACTGCATCGGCGCGGCCGTGGGAGCC

ACGCCCGAGGGGCCCTACCGCGCGTTCGACGAGCCGTTCGCGTGCCACGAGGAGCAGGGCGGCAGCATCGACC

CCTCGGGCTTCAGGGACACGGCGACCGGCAAGCGCTACGTCGTGTACAAGATCGACGGCAACAACAACGGCAA

CGGCGGGCTGTGCGGCAACATGGTCGCGCCGCAGGTGCCCACGCCCATCATGCTGCAGGAAGTCGGCCCGGAC

GGCTACACCAAGATCGGCGAGCCCAAGCAGATCCTCGACAGGGGCGAGGCCGACGGCCCGCTGGTCGAGGCTC

CGAATCTCGTCAGGACCGAGGACGGCCGGTACGTGCTGTTCTTCAGCTCGAACTGCTACTCCACCGAAATGTA

CGACATTGGCTACGCCTTCGCGGACAGCGTCGAGGGCCCCTACACCAAGGCCGGCCCGTTTGCGGTGACGGGC

ACTGCGGGACTGAAGGCGCCCGGCGGCGCTACGGTTGCCGAGGATGGGAAGCACATGGTCTTCCACGCCGCGG

ATAGCAAGGGTGGCCGGTCCATGTACACGACTGAGGTGTCGTTCGCGCTCGGCCCGGATAGGAAGATGAGGGT
```

-continued

```
TGCGGCGAAGGCGGCTTAATGTTGTCCCGCATTCTGGCaATGCACTTGGAGAGCTGGAATGTTTATGACATGT

TGGTTCACGCCTGGGTTTACGCTATTGAGGATATGGCTGTGAAGTCCCTCTAATGTATAAAGCATAATAGATT

TTTGTTGAAGACTTGCAAGTTGA

SEQ ID NO: 302
LENGTH: 1110
TYPE: DNA
ORGANISM: M. phaseolina
FEATURE NAME/KEY: CDS
LOCATION: (1)...(1110)
atgttctacactcgtttcgccgcggcggccctgctgtccgcctccgccctcaccgaggcg
 M  F  Y  T  R  F  A  A  A  A  L  L  S  A  S  A  L  T  E  A gctcctaccaacatgaccgccggcggcttcaagccaccgcacttcaagacccaacgggtc
 A  P  T  N  M  T  A  G  G  F  K  P  P  H  F  K  T  Q  R  V gtcgacaccgaattcgccgacccgggcatcctcaaggtcggcgacacctggtacgccttc
 V  D  T  E  F  A  D  P  G  I  L  K  V  G  D  T  W  Y  A  F gcgaccaacaacggcaaatccaacgtccgcgttgccacctcgaccgacttcgaacactgg
 A  T  N  N  G  K  S  N  V  R  V  A  T  S  T  D  F  E  H  W accgtcaaggagaagtgggacgcgctgccgctcaccggcgcgtggaccgcgcagcccaag
 T  V  K  E  K  W  D  A  L  P  L  T  G  A  W  T  A  Q  P  K atgcagacggagaagctgctgccacgtccgacaagttcctcgacagcgtcggcgggctc
 M  Q  T  E  K  L  L  P  T  S  D  K  F  L  D  S  V  G  G  L ctcgagggccggtggccgtggtccaacgccgcccgcgtctgggcgcccgacgccgtg
 L  E  G  R  W  P  W  S  N  A  P  P  A  V  W  A  P  D  A  V accaacgacgacggcatgcacgtgctctactactcggcgcagcagcgcggccagaagcgg
 T  N  D  D  G  M  H  V  L  Y  Y  S  A  Q  Q  R  G  Q  K  R cactgcatcggcgcggccgtgggagccacgcccgaggggcctaccgcgcgttcgacgag
 H  C  I  G  A  A  V  G  A  T  P  E  G  P  Y  R  A  F  D  E ccgttcgcgtgccacgaggagcagggcggcagcatcgacccctcgggcttcagggacacg
 P  F  A  C  H  E  E  Q  G  G  S  I  D  P  S  G  F  R  D  T gcgaccggcaagcgctacgtcgtgtacaagatcgacggcaacaacaacggcaacggcggg
 A  T  G  K  R  Y  V  V  Y  K  I  D  G  N  N  N  G  N  G  G ctgtgcggcaacatggtcgcgccgcaggtgcccacgcccatcatgctgcaggaagtcggc
 L  C  G  N  M  V  A  P  Q  V  P  T  P  I  M  L  Q  E  V  G ccggacggctacaccaagatcggcgagcccaagcagatcctcgacagggcgaggccgac
 P  D  G  Y  T  K  I  G  E  P  K  Q  I  L  D  R  G  E  A  D ggcccgctggtcgaggctccgaatctcgtcaggaccgaggacggccggtacgtgctgttc
 G  P  L  V  E  A  P  N  L  V  R  T  E  D  G  R  Y  V  L  F ttcagctcgaactgctactccaccgaaatgtacgacattggctacgccttcgcggacagc
 F  S  S  N  C  Y  S  T  E  M  Y  D  I  G  Y  A  F  A  D  S gtcgagggcccctacaccaaggccggcccgtttgcggtgacgggcactgcgggactgaag
 V  E  G  P  Y  T  K  A  G  P  F  A  V  T  G  T  A  G  L  K gcgcccggcggcgctacggttgccgaggatgggaagcacatggtcttccacgccgcggat
 A  P  G  G  A  T  V  A  E  D  G  K  H  M  V  F  H  A  A  D agcaagggtggccggtccatgtacacgactgaggtgtcgttcgcgctcggcccggatagg
 S  K  G  G  R  S  M  Y  T  T  E  V  S  F  A  L  G  P  D  R aagatgagggttgcggcgaaggcggcttaa
 K  M  R  V  A  A  K  A  A  -

SEQ ID NO: 303
LENGTH: 369
TYPE: PRT
ORGANISM: M. phaseolina
MFYTRFAAAALLSASALTEAAPTNMTAGGFKPPHFKTQRVVDTEFADPGILKVGDTWYAFATNNGKSNVRVAT

STDFEHWTVKEKWDALPLTGAWTAQPKMQTEKLLPTSDKFLDSVGGLLEGRWPWSNAPPAVWAPDAVTNDDGM

HVLYYSAQQRGQKRHCIGAAVGATPEGPYRAFDEPFACHEEQGGSIDPSGFRDTATGKRYVVYKIDGNNNGNG

GLCGNMVAPQVPTPIMLQEVGPDGYTKIGEPKQILDRGEADGPLVEAPNLVRTEDGRYVLFFSSNCYSTEMYD
```

-continued

IGYAFADSVEGPYTKAGPFAVTGTAGLKAPGGATVAEDGKHMVFHAADSKGGRSMYTTEVSFALGPDRKMRVA

AKAA*

SEQ ID NO: 304
LENGTH: 1399 (including 150 bp 5' UTR and 150 bp 3' UTR)
TYPE: DNA
ORGANISM: M. phaseolina
CCATAGTGCATGTCCGCGGCCGCTGAAGTCATCAGTATAAATGCTGCTCGACTTGCTCGCATCTAGTGCTATC

AACCACTGAACCTCATCTGCCATTTGAAAAGCCGGCCTTTCGTCCTGTACCAACACTTCTTTCTCTCATTCAC

CAAAATGCACGGCTCTACCGCTCTTTCACTTCTCATTGCCTTCCCAGCCGCCTTCGGCGCCGTCCTCCCTCGC

CAGGCTGCGGAGAGCATCAACGAAAAGTTCGTTGCAAAGGGCAAGAAGTACTTCGGTACTTGCGCCGACCAGG

GCACCCTCACCAGCGGATCAAATGCGGCAATCATCAAGGCCGACTTCGGGCAGGTCACGCCTGAGAACAGCAT

GAAATGGGATGCAGTCGAGCCATCCCAGGGCAACTTTAACTTCGCTGGGGCGGACTACCTGGTTGACTTTGCC

ACTACCAACAACAAGCTCATCCGCGGACACACTACGGTGTGGCATTCGCAGCTGCCTTCCTGGGTGAGCAGCA

TCACGGACAAGTCCACCTTGACGAAGGTCATCCAGGACCACGTCTCCAAGGAGATCGGAAGATACAAGGGCAA

AATCTATGCCTGGGTGCGTCTCAATCTCAAACATCTTCCCGGCCAGCTGGTGGAGAACGCGCTTACTGACAAG

CCCATCTCAGGACGTGGTGAACGAGATCTTCAACGAAGACGGCACCCTCAGGTCCTCCGTTTTCTACAACGTC

CTCGGCGAAGACTTCGTCCGCATTGCCTTCGAAGCTGCCCGCGCCGCCGACCCGAACGCTAAGCTGTACATCA

ACGACTACAAGTACGTCTTGCATCTAATCATTTTCGGACACGTGCGCTGACCCCTCATTCCTTCTAGCCTCGA

CAGCGCCACGTACGCCAAGACGACCGGCTTGATCAGCAAAGTCAAGCAGTGGATCGCCGCCGGCGTTCCCATC

GACGGCATCGGCTCGCAGTCGCACCTGTCCGCCGGCGGCGCCTCCGGCACGGGCGCCGCGATGAAGGCGCTGT

GCGCTGCGGCCTCCGAGTGCGCCATCACCGAGCTTGACATCGCGGGTGCGGCGGCGAGCGACTACGTGACTGC

TACGAAGGCTTGCCTGGATGTCGAGAACTGCGTCGGTATCACGGTCTGGGGCGTCAGCGATGCCAACAGCTGG

AGGGCCAGCTCGTCTCCGCTGCTGTTCGATGCGTCGTACCAGCCGAAGGCGGCGTACACGGCTATCATCAATG

CCTTGTAGGGAGGATGAGGAGTGTAGATGGTTTCGGTTCTTGTATGTATAGAAGAGCGATGAGCTGGTAAATA

GCTGATCGTTCTCTTTTGATCATCGCCCTTATCTGTGTAGCACTATAGAAATATATAAATATATATATATATA

TATATATCACGC

SEQ ID NO: 305
LENGTH: 972
TYPE: DNA
ORGANISM: M. phaseolina
FEATURE NAME/KEY: CDS
LOCATION: (1)...(972)
atgcacggctctaccgctctttcacttctcattgccttcccagccgccttcggcgccgtc
 M  H  G  S  T  A  L  S  L  L  I  A  F  P  A  A  F  G  A  V ctccctcgccaggctgcggagagcatcaacgaaaagttcgttgcaaagggcaagaagtac
 L  P  R  Q  A  A  E  S  I  N  E  K  F  V  A  K  G  K  K  Y ttcggtacttgcgccgaccagggcaccctcaccagcggatcaaatgcggcaatcatcaag
 F  G  T  C  A  D  Q  G  T  L  T  S  G  S  N  A  A  I  I  K gccgacttcgggcaggtcacgcctgagaacagcatgaaatgggatgcagtcgagccatcc
 A  D  F  G  Q  V  T  P  E  N  S  M  K  W  D  A  V  E  P  S cagggcaactttaacttcgctggggcggactacctggttgactttgccactaccaacaac
 Q  G  N  F  N  F  A  G  A  D  Y  L  V  D  F  A  T  T  N  N aagctcatccgcggacacactacggtgtggcattcgcagctgccttcctgggtgagcagc
 K  L  I  R  G  H  T  T  V  W  H  S  Q  L  P  S  W  V  S  S atcacggacaagtccaccttgacgaaggtcatccaggaccacgtctccaaggagatcgga
 I  T  D  K  S  T  L  T  K  V  I  Q  D  H  V  S  K  E  I  G agatacaagggcaaaatctatgcctgggacgtggtaacgagatcttcaacgaagacggc
 R  Y  K  G  K  I  Y  A  W  D  V  V  N  E  I  F  N  E  D  G accctcaggtcctccgttttctacaacgtcctcggcgaagacttcgtccgcattgccttc
 T  L  R  S  S  V  F  Y  N  V  L  G  E  D  F  V  R  I  A  F -continued

```
gaagctgcccgcgccgccgacccgaacgctaagctgtacatcaacgactacaacctcgac
 E   A   A   R   A   A   D   P   N   A   K   L   Y   I   N   D   Y   N   L   D agcgccacgtacgccaagacgaccggcttgatcagcaaagtcaagcagtggatcgccgcc
 S   A   T   Y   A   K   T   T   G   L   I   S   K   V   K   Q   W   I   A   A ggcgttcccatcgacggcatcggctcgcagtcgcacctgtccgccggcggcgcctccggc
 G   V   P   I   D   G   I   G   S   Q   S   H   L   S   A   G   G   A   S   G acgggcgccgcgatgaaggcgctgtgcgctgcggcctccgagtgcgccatcaccgagctt
 T   G   A   A   M   K   A   L   C   A   A   A   S   E   C   A   I   T   E   L gacatcgcgggtgcggcggcgagcgactacgtgactgctacgaaggcttgcctggatgtc
 D   I   A   G   A   A   A   S   D   Y   V   T   A   T   K   A   C   L   D   V gagaactgcgtcggtatcacggtctggggcgtcagcgatgccaacagctggagggccagc
 E   N   C   V   G   I   T   V   W   G   V   S   D   A   N   S   W   R   A   S tcgtctccgctgctgttcgatgcgtcgtaccagccgaaggcggcgtacacggctatcatc
 S   S   P   L   L   F   D   A   S   Y   Q   P   K   A   A   Y   T   A   I   I aatgccttgtag
 N   A   L   -

SEQ ID NO: 306
LENGTH: 323
TYPE: PRT
ORGANISM: M. phaseolina
MHGSTALSLLIAFPAAFGAVLPRQAAESINEKFVAKGKKYFGTCADQGTLTSGSNAAIIKADFGQVTPENSMK

WDAVEPSQGNFNFAGADYLVDFATTNNKLIRGHTTVWHSQLPSWVSSITDKSTLTKVIQDHVSKEIGRYKGKI

YAWDVVNEIFNEDGTLRSSVFYNVLGEDFVRIAFEAARAADPNAKLYINDYNLDSATYAKTTGLISKVKQWIA

AGVPIDGIGSQSHLSAGGASGTGAAMKALCAAASECAITELDIAGAAASDYVTATKACLDVENCVGITVWGVS

DANSWRASSSPLLFDASYQPKAAYTAIINAL*

SEQ ID NO: 307
LENGTH: 1556 (including 150 bp 5' UTR and 150 bp 3' UTR)
TYPE: DNA
ORGANISM: M. phaseolina
TTGGGGCCAATGCGGAGGACAAGGCTGGAGCGGTGACAGCAGCTGCGTATCTGGCTACACTTGTGTGACTGTA

AACCAATGGTACTCTCAGGTGATTATTTTCCTCAACGCCACACCCTGGGGCTTGCGTTAACACTCCATGCTCC

GCAGATGTGCCAGCAAGGGTCCGCACCCCCAGCTACCACCCTGGTCTCCTCCACCACGGCAGCCACCAGCGCC

ACCGCGCCCGCCTCCACCGCAACCGGCGGCCTGGACGCACGCTTCAAGGCTCGAGGCAAGAAGTATTATGGGG

TTGCCACGGACCAGGGACGCCTCACGGCCGGCCAAAACGCAGCAATCATCCAGGCCGACTTCGGCCAAGTCAC

GCCTGAGAATAGCATGAAGTGGGATACAATCGAGCCGTCGCGCGGCTCCTTTAACTTTGCCCAAGCCGACTAC

CTCGTCAACTGGGCAACCACCAACAATAAGCTGATCCGCGGTCATACCACTGTCTGGCACTCGCAGCTGCCGA

ACTGGGTTAGCAGCATCACTGACAAGGCCACCTTGACCACCGTGATGCAGAACCACATCGCCACCGAGATTGG

GAGGTATAAGGGCAAGATCTATGCCTGGGTAAGTGCTTGGTCATGAAATATTGTTCTGGATCGTCTGATCCGT

CCACCGTGTGGCTGGGGTCATTGTCGCCCTCTGCGTTGCTCCCTCAACCGATCACACATATGTCAGCAAGAAG

CGCAACAAACCATGCTGACGCCCTCCCCAGGACGTTGTCAATGAAATATTTAACGAAGACGGCTCTTTCCGCT

CCTCGGTCTTCTACAACGTCCTTGGCCAGGACTTCGTCCGCCTTGCCTTCGAGGCCGCCCGCGCCGCCGACCC

CAACGCCAAGCTCTACATCAACGACTACAAGTGAGTTCCCCCGTTCATCTACCTCCTCGCCAACCCCCCATCC

CCCTTCCGCACATACATACATACATACATACACACACACAACAAGACTAACGCATGCCCCTCGCAAAAACC

CCCAGCCTCGACAGCGCCACCTACGCCAAAACAACCGGCCTCATTTCCAAAGTCAAAGCCTGGATCGCGGCCG

GCGTCCCCATCGACGGCATTGGCTCGCAGTCTCACCTGTCGGCGGGCCAAGCGTCCGGCACCGGCGCCGCCAT

GAAGGCCCTCTGCGCCGCCGCGCCCGAGTGCGCCATCACCGAGCTCGACATCGTCAACGCCGCACCCGCCGAC

TACGTCGCCGTCACCAAGGCCTGCCTCGACGTCGCCAACTGCGTGGGCATTACGGTCTGGGGCTTGCGCGACC

CGGATAGCTGGAGGGCCAGTAACAACCCCCTGCTGTTTGATGCGAATTATCAGCCTAAGCCGGCGTACACGGC

GGTGTTGAACTCGCTGTAGGCGGGGCGTGTGTGTGGTTTTTCTGCGGGCGAGGGAGCAGAGGAGGAGTGCGTA
```

```
GCACGTTCTATGTAGGTATTTTTTTTTTTTTTCCTTGGAACACGTACATATATGACAACGGGATGAGGGAGAG

AAGAAAAGGTGGGATATCGCCGC
```

SEQ ID NO: 308
LENGTH: 987
TYPE: DNA
ORGANISM: M. phaseolina
FEATURE NAME/KEY: CDS
LOCATION: (1)...(987)

```
atgtgccagcaagggtccgcacccccagctaccaccctggtctcctccaccacggcagcc
 M  C  Q  Q  G  S  A  P  P  A  T  T  L  V  S  S  T  T  A  A accagcgccaccgcgcccgcctccaccgcaaccggcggcctggacgcacgcttcaaggct
 T  S  A  T  A  P  A  S  T  A  T  G  G  L  D  A  R  F  K  A cgaggcaagaagtattatggggttgccacggaccagggacgcctcacggccggccaaaac
 R  G  K  K  Y  Y  G  V  A  T  D  Q  G  R  L  T  A  G  Q  N gcagcaatcatccaggccgacttcggccaagtcacgcctgagaatagcatgaagtgggat
 A  A  I  I  Q  A  D  F  G  Q  V  T  P  E  N  S  M  K  W  D acaatcgagccgtcgcgcggctcctttaactttgcccaagccgactacctcgtcaactgg
 T  I  E  P  S  R  G  S  F  N  F  A  Q  A  D  Y  L  V  N  W gcaaccaccaacaataagctgatccgcggtcataccactgtctggcactcgcagctgccg
 A  T  T  N  N  K  L  I  R  G  H  T  T  V  W  H  S  Q  L  P aactgggttagcagcatcactgacaaggccaccttgaccaccgtgatgcagaaccacatc
 N  W  V  S  S  I  T  D  K  A  T  L  T  T  V  M  Q  N  H  I gccaccgagattggaggtataagggcaagatctatgcctgggacgttgtcaatgaaata
 A  T  E  I  G  R  Y  K  G  K  I  Y  A  W  D  V  V  N  E  I tttaacgaagacggctcttttccgctcctcggtcttctacaacgtccttggccaggacttc
 F  N  E  D  G  S  F  R  S  S  V  F  Y  N  V  L  G  Q  D  F gtccgccttgccttcgaggccgcccgcgccgccgaccccaacgccaagctctacatcaac
 V  R  L  A  F  E  A  A  R  A  A  D  P  N  A  K  L  Y  I  N gactacaacctcgacagcgccacctacgccaaaacaaccggcctcatttccaaagtcaaa
 D  Y  N  L  D  S  A  T  Y  A  K  T  T  G  L  I  S  K  V  K gcctggatcgcggccggcgtccccatcgacggcattggctcgcagtctcacctgtcggcg
 A  W  I  A  A  G  V  P  I  D  G  I  G  S  Q  S  H  L  S  A ggccaagcgtccggcaccggcgccgccatgaaggccctctcgccgccgcgcccgagtgc
 G  Q  A  S  G  T  G  A  A  M  K  A  L  C  A  A  A  P  E  C gccatcaccgagctcgacatcgtcaacgccgcacccgccgactacgtcgccgtcaccaag
 A  I  T  E  L  D  I  V  N  A  A  P  A  D  Y  V  A  V  T  K gcctgcctcgacgtcgccaactgcgtgggcattacggtctggggcttgcgcgacccggat
 A  C  L  D  V  A  N  C  V  G  I  T  V  W  G  L  R  D  P  D agctggagggccagtaacaaccccctgctgtttgatgcgaattatcagcctaagccggcg
 S  W  R  A  S  N  N  P  L  L  F  D  A  N  Y  Q  P  K  P  A tacacggcggtgttgaactcgctgtag
 Y  T  A  V  L  N  S  L  -
```

SEQ ID NO: 309
LENGTH: 328
TYPE: PRT
ORGANISM: M. phaseolina

MCQQGSAPPATTLVSSTTAATSATAPASTATGGLDARFKARGKKYYGVATDQGRLTAGQNAAIIQADFGQVTP

ENSMKWDTIEPSRGSFNFAQADYLVNWATTNNKLIRGHTTVWHSQLPNWVSSITDKATLTTVMQNHIATEIGR

YKGKIYAWDVVNEIFNEDGSFRSSVFYNVLGQDFVRLAFEAARAADPNAKLYINDYNLDSATYAKTTGLISKV

KAWIAAGVPIDGIGSQSHLSAGQASGTGAAMKALCAAAPECAITELDIVNAAPADYVAVTKACLDVANCVGIT

VWGLRDPDSWRASNNPLLFDANYQPKPAYTAVLNSL*

-continued

SEQ ID NO: 310
LENGTH: 1761 (including 150 bp 5' UTR and 150 bp 3' UTR)
TYPE: DNA
ORGANISM: *M. phaseolina*

GCGGAACTCCGGCTCGACGCGCTCTCCCCCCACATTGCGTCCAGGAGTATATATGTGCTTCATGCTCTCCGTC

CAAGAGTGTTTCGTTCCTTACCGCCTGCCGTAGTAGCTGCTTCTCTCTTTCTCCAGACTTGAGGTCACTCTTT

CGCCATGTCATTCCTTGCTACTACTTTCACTTCTCTTCTCGCCGTCCAGGCCGCTCAAGCCATCCCATTCTCG

TGAGCTTCTCCACATCATTTCCGCACTTGCCATTGCTGACTTCACCGGCGTAGTCGCCGTGCTGCAGCTGGTC

TGAACACGGCTGCGCAAGCTGCCGGCCTTGAGTACTTCGGTTCTGCCACTGACAACCCCGAACTCACCGACAC

TGCCTATGTCGCCGGCTTGAACAACACCGCCGACTTCGGCCAGATTACTCCCGGCAACTCGCAGAAGTGGGAC

ACCATCGAGGCCTCGCGCAACACTTTCTCCTACACCAAGGGAGATGTGATTGCTGACCTTGCTGAGGCTAACG

GCCAGAAGCTGCGCTGCCACACCCTTGTCTGGTACAACCAGCTGCCCAACTGGGTCAAGAGCGGTGGATTCGA

CAACGCCACGCTGGTCGAGATTCTACAGAACCACATCAAGAACGAGGTCACCCACTACAAGGGCCGTTGTGCG

CACTGGGATGTCGTCAACGAGGCCCTCAACGAGGATGGCACTTACCGCGATATGGTCTTCTACAACACCATTG

GCGAGGCTTACATTCCCATTGCCTTCGCTGCCGCTGCCGCGGCCGACCCCGAAGCCAAGCTCTACTACAACGA

CTACAACATTGAGTGGTCCGGCGACAAGCAGAAGGCTGCCAAGAAGATCGTCCAGATGATTCAGTCCTATGGC

GTCAAGATCGATGGCGTTGGTCTTCAGGCTCACTTCACTGTCGGCAACACCGCCTCCCAGGATGCCATTGAAG

GCGTGATCAAGGACTTCGCCTCCCTTGGCGTTGAAGTCGCCATCACTGAGCTCGACATCCGTATGGAGACCCC

CGCAACCGATGCAAACCTCAAGCAGCAGGCCACCGACTACCAGACCGTCGTCAATGCTTGTTTGAATCAGAAA

GACGCCTGCAAGGGTATTACCATTTGGGACTACACGGACAAGTACTCTTGGGTGTGAGTAATAACCGATCTCC

ATTTATTCTTCTCAACTCACCCGTAATTACACAGGCCTTCCACCTTCTCCGGATACGGCGCTGCCCTTCCTTG

GGATGAGAACTTGGAGAAGAAGCCTGCCTACGATGCCATCCTGTCCGCCCTCGAGGCGGCGGCTGGCGCCAAC

AGCAGCAGTACGTCTGTCCCTGCGGCCAACACCACCACCCCGGCCGCCACCGCCCCCACCGCTACTGCCACTA

AGACTTCGGGCAGCGCAGTAGCCGCCCAATCGGCGACTTCTGTCCAGGTAGCGGAGACCCCCGCTACTACACC

GGCCGCTTCTACTCCGACTTCTGGTTCCACCGCTGGCGCCGCTGTGGCCAGATATGGCCAGTGCGGAGGTGTG

AACTACTCCGGCTCGACAACCTGCGAGAGCGGCTCCACCTGCAAGGAGTGGAATTCGTATTATCATCAATGCG

TGTAATTAGGCTTCGTGAGAAAGGCTTGATGCTGAGAACGAGTGTTGTCGTTTGCCCCTTCATTGTCGATACT

TTTCAGACAGACATACTATACTTTACTTCTTCAAATACTTCAAAGCTCACCATACCCTCTACAAACTCTTGAC

AGCTAGCTG

SEQ ID NO: 311
LENGTH: 1353
TYPE: DNA
ORGANISM: *M. phaseolina*
FEATURE NAME/KEY: CDS
LOCATION: (1)...(1353)

atgtcattccttgctactactttcacttctcttctcgccgtccaggccgctcaagccatc
M S F L A T T F T S L L A V Q A A Q A I ccattctctcgccgtgctgcagctggtctgaacacggctgcgcaagctgccggccttgag
P F S R R A A A G L N T A A Q A A G L E tacttcggttctgccactgacaaccccgaactcaccgacactgcctatgtcgccggcttg
Y F G S A T D N P E L T D T A Y V A G L aacaacaccgccgacttcggccagattactcccggcaactcgcagaagtgggacaccatc
N N T A D F G Q I T P G N S Q K W D T I gaggcctcgcgcaacactttctcctacaccaagggagatgtgattgctgaccttgctgag
E A S R N T F S Y T K G D V I A D L A E gctaacggccagaagctgcgctgccacacccttgtctggtacaaccagctgcccaactgg
A N G Q K L R C H T L V W Y N Q L P N W gtcaagagcggtggattcgacaacgccacgctggtcgagattctacagaaccacatcaag
V K S G G F D N A T L V E I L Q N H I K -continued

```
aacgaggtcacccactacaagggccgttgtgcgcactgggatgtcgtcaacgaggccctc
 N  E  V  T  H  Y  K  G  R  C  A  H  W  D  V  V  N  E  A  L aacgaggatggcacttaccgcgatatggtcttctacaacaccattggcgaggcttacatt
 N  E  D  G  T  Y  R  D  M  V  F  Y  N  T  I  G  E  A  Y  I cccattgccttcgctgccgctgccgcggccgaccccgaagccaagctctactacaacgac
 P  I  A  F  A  A  A  A  A  D  P  E  A  K  L  Y  Y  N  D tacaacattgagtggtccggcgacaagcagaaggctgccaagaagatcgtccagatgatt
 Y  N  I  E  W  S  G  D  K  Q  K  A  A  K  K  I  V  Q  M  I cagtcctatggcgtcaagatcgatggcgttggtcttcaggctcacttcactgtcggcaac
 Q  S  Y  G  V  K  I  D  G  V  G  L  Q  A  H  F  T  V  G  N accgcctcccaggatgccattgaaggcgtgatcaaggacttcgcctcccttggcgttgaa
 T  A  S  Q  D  A  I  E  G  V  I  K  D  F  A  S  LG  V  E gtcgccatcactgagctcgacatccgtatggagaccccccgcaaccgatgcaaacctcaag
 V  A  I  T  E  L  D  I  R  M  E  T  P  A  T  D  A  N  L  K cagcaggccaccgactaccagaccgtcgtcaatgcttgtttgaatcagaaagacgcctgc
 Q  Q  A  T  D  Y  Q  T  V  V  N  A  C  L  N  Q  K  D  A  C aagggtattaccatttgggactacacggacaagtactcttgggtgccttccaccttctcc
 K  G  I  T  I  W  D  Y  T  D  K  Y  S  W  V  P  S  T  F  S ggatacggcgctgcccttccttgggatgagaacttggagaagaagcctgcctacgatgcc
 G  Y  G  A  A  L  P  W  D  E  N  L  E  K  K  P  A  Y  D  A atcctgtccgccctcgaggcggcggctggcgccaacagcagcagtacgtctgtccctgcg
 I  L  S  A  L  E  A  A  A  G  A  N  S  S  S  T  S  V  P  A gccaacaccaccaccccggccgccaccgcccccaccgctactgccactaagacttcgggc
 A  N  T  T  T  P  A  A  T  A  P  T  A  T  A  T  K  T  S  G agcgcagtagccgcccaatcggcgacttctgtccaggtagcggagaccccgctactaca
 S  A  V  A  A  Q  S  A  T  S  V  Q  V  A  E  T  P  A  T  T ccggccgcttctactccgacttctggttccaccgctggcgccgctgtggccagatatggc
 P  A  A  S  T  P  T  S  G  S  T  A  G  A  A  V  A  R  Y  G cagtgcggaggtgtgaactactccggctcgacaacctgcgagagcggctccacctgcaag
 Q  C  G  G  V  N  Y  S  G  S  T  T  C  E  S  G  S  T  C  K gagtggaattcgtattatcatcaatgcgtgtaa
 E  W  N  S  Y  Y  H  Q  C  V  -

SEQ ID NO: 312
LENGTH: 450
TYPE: PRT
ORGANISM: M. phaseolina
MSFLATTFTSLLAVQAAQAIPFSRRAAAGLNTAAQAAGLEYFGSATDNPELTDTAYVAGLNNTADFGQITPGN

SQKWDTIEASRNTFSYTKGDVIADLAEANGQKLRCHTLVWYNQLPNWVKSGGFDNATLVEILQNHIKNEVTHY

KGRCAHWDVVNEALNEDGTYRDMVFYNTIGEAYIPIAFAAAAAADPEAKLYYNDYNIEWSGDKQKAAKKIVQM

IQSYGVKIDGVGLQAHFTVGNTASQDAIEGVIKDFASLGVEVAITELDIRMETPATDANLKQQATDYQTVVNA

CLNQKDACKGITIWDYTDKYSWVPSTFSGYGAALPWDENLEKKPAYDAILSALEAAAGANSSSTSVPAANTTT

PAATAPTATATKTSGSAVAAQSATSVQVAETPATTPAASTPTSGSTAGAAVARYGQCGGVNYSGSTTCESGST

CKEWNSYYHQCV*

SEQ ID NO: 313
LENGTH: 1818 (including 150 bp 5' UTR and 150 bp 3' UTR)
TYPE: DNA
ORGANISM: M. phaseolina
CTGGCTTCGACAGCCGCGGAGAGTGGTGGGTAAACTATGAAACATTGCAGTACCCCACTTGGTCGCCAAGCCG

CAGAAACGATATACATAAAGATGGACAGGATTTCCAGGTCGTACGGGCAAGCTTTACATCCTGTCGCTGCTTT

TGCAATGCATTTGCTCGTCCTGCTGTTATCCGCAGCTGCGGCTTCGGCCCAGAGCTCCTCAATCACTTTCAAC

TCATCCGGCAATCCAATCCTTGCGGACGGCTCGTATTACTCAGCGGATCCAGCTCCACTAGTGGTTAACAATA

CTTTATACATCATCGCAGGGCATGACGAGGCGCCCGTGGACCAAAACGCGTTTATTATCAATGAGTGGGAGCT

GTTTGTGTCGGCTTCACCAGACCCTTCGGGCGGAGAATGGACCTTCTACCCCGGCCTCGCACGACCCCACGAA
```

-continued

```
ATATTCTCCTGGGCTGCGCAAGGGACCGCCTACGCCGCCCAGATAGTCCAGGGCCCAGACGACAAGTTTTACC

TGTACGCGCCTGTGACAGAAGCAGATTCTAAGAACTCAGATCCATTCGCAATCGGAGTTGCAGTTTCCGATAG

CCCCCTGGGCCCCTGGAcCGATGCTCACCCTTCCGGCCCGGTCTTTTCGCAATCCGTACCCGCGCCCGGAAAC

AGCATCCAAAACATAGACCCCACTATTCTCGTGGATGACGACCAAAAAGTGTATGTCTTTTATGGCACCTTTG

GGCAGCTCCGAGCCTACGAAATGGCCGACGACATGGTCACTCCGGCATCAAATGTCACCATTATTGACACTTT

GACTGGCTTCTTTGAAGCACCCTGGGTCATGAAGAGGAATGGCACGTACTACATGCTGTATGCGGCAAACAAC

GCAGGACCGGAATCTCCCTGCACGCCCACCTCATACCATGCGTGCATCGCCTACGGAACCGCCTCATCGCCTC

TCGGCCCCTGGACATTCCGCGGTGTTGTTCTGGGCATCGTCTCCTCCACAACCTCTCACCCCGGCGCTGTCGA

AGTGGGCGGTGAATGGTTCATCGTCTACCATACAGCGGACGCAGAGGGCGGCGGGCACTTCCGGCGCAGCGTT

GCCCTCGATCGTCTGACCTTCGATGATGCCCAGTCTCCCCCGGCCATCAACAAAGTCGTGCAAACGAAGCGCC

CGCAACCTGCACCGGCGCCGACCCGCAATATTGCGCCCAAAGGAAAAGCGGCTTCGGTCAGAGGGACGCCGAT

CCAATACTGGGTTGAATCCCTTCACGACGGCGAAATTCCCGCGAATCCTCTTCCCCCGGACTACTGGAGCTCC

TACGACGGTGAATCTTCGCCGCAGGAGAGCACTCTTGTTTATGAATGGGACGAGCCGGTTTCTCTAAATGGTG

TGCGCATGGTTTTCTTCTCCGATCAGCCCGCCGGCGCCGACGTCGGTGTACCGCCGCCGTCCAGCTGGCATGT

GGAGTTCAAGAACTCAGACGGCGCATGGGAACCAGTTTCCAACTCGACGGCATATCCGCTCGACGTTACTGAT

GACCCAGAAGAGGTCTCATTTGCTGAAATCAACACGGTTTCCATCCGAGCCATATTGGGTGCGTCAGGAAGTG

GAGAGCAATACGGCGGTGTGGCGGTAAAGGAGTGGGAAGCATTGGCGCCAAACGCCGAATAAGAGCAATCTCA

TATGCAACGTTCAACATGGTACGTAGCGTCGCTGGCATGCGGCCTGCATGGAACACGTGTTCTTGTATATACT

CATCAATCAAGGAAACCGACCTCCACTTTGTTACGGCAGTTTAGCTTCCACAAAATTTCAGGGGCA
```

```
SEQ ID NO: 314
LENGTH: 1518
TYPE: DNA
ORGANISM: M. phaseolina
FEATURE NAME/KEY: CDS
LOCATION: (1)...(1518)
atgcatttgctcgtcctgctgttatccgcagctgcggcttcggcccagagctcctcaatc
 M   H   L   L   V   L   L   L   S   A   A   A   A   S   A   Q   S   S   S   I actttcaactcatccggcaatccaatccttgcggacggctcgtattactcagcggatcca
 T   F   N   S   S   G   N   P   I   L   A   D   G   S   Y   Y   S   A   D   P gctccactagtggttaacaatactttatacatcatcgcagggcatgacgaggcgcccgtg
 A   P   L   V   V   N   N   T   L   Y   I   I   A   G   H   D   E   A   P   V gaccaaaacgcgtttattatcaatgagtgggagctgtttgtgtcggcttcaccagaccct
 D   Q   N   A   F   I   I   N   E   W   E   L   F   V   S   A   S   P   D   P tcgggcggagaatggaccttctaccccggcctcgcacgaccccacgaaatattctcctgg
 S   G   G   E   W   T   F   Y   P   G   L   A   R   P   H   E   I   F   S   W gctgcgcaagggaccgcctacgccgcccagatagtccagggcccagacgacaagttttac
 A   A   Q   G   T   A   Y   A   A   Q   I   V   Q   G   P   D   D   K   F   Y ctgtacgcgcctgtgacagaagcagattctaagaactcagatccattcgcaatcggagtt
 L   Y   A   P   V   T   E   A   D   S   K   N   S   D   P   F   A   I   G   V gcagtttccgatagccccctgggccctggaccgatgctcacccttccggcccggtctttt
 A   V   S   D   S   P   L   G   P   W   T   D   A   H   P   S   G   P   V   F tcgcaatccgtacccgcgcccggaaacagcatccaaaacatagaccccactattctcgtg
 S   Q   S   V   P   A   P   G   N   S   I   Q   N   I   D   P   T   I   L   V gatgacgaccaaaaagtgtatgtcttttatggcacctttgggcagctccgagcctacgaa
 D   D   D   Q   K   V   Y   V   F   Y   G   T   F   G   Q   L   R   A   Y   E atggccgacgacatggtcactccggcatcaaatgtcaccattattgacactttgactggc
 M   A   D   D   M   V   T   P   A   S   N   V   T   I   I   D   T   L   T   G ttctttgaagcaccctgggtcatgaagaggaatggcacgtactacatgctgtatgcggca
 F   F   E   A   P   W   V   M   K   R   N   G   T   Y   Y   M   L   Y   A   A
```

```
aacaacgcaggaccggaatctccctgcacgcccacctcataccatgcgtgcatcgcctac
 N  N  A  G  P  E  S  P  C  T  P  T  S  Y  H  A  C  I  A  Y ggaaccgcctcatcgcctctcggcccctggacattccgcggtgttgttctgggcatcgtc
 G  T  A  S  S  P  L  G  P  W  T  F  R  G  V  V  L  G  I  V tcctccacaacctctcaccccggcgctgtcgaagtgggcggtgaatggttcatcgtctac
 S  S  T  T  S  H  P  G  A  V  E  V  G  G  E  W  F  I  V  Y catacagcggacgcagagggcggcgggcacttccggcgcagcgttgccctcgatcgtctg
 H  T  A  D  A  E  G  G  G  H  F  R  R  S  V  A  L  D  R  L accttcgatgatgcccagtctcccccggccatcaacaaagtcgtgcaaacgaagcgcccg
 T  F  D  D  A  Q  S  P  P  A  I  N  K  V  V  Q  T  K  R  P caacctgcaccggcgccgacccgcaatattgcgcccaaaggaaaagcggcttcggtcaga
 Q  P  A  P  A  P  T  R  N  I  A  P  K  G  K  A  A  S  V  R gggacgccgatccaatactgggttgaatccttcacgacggcgaaattcccgcgaatcct
 G  T  P  I  Q  Y  W  V  E  S  L  H  D  G  E  I  P  A  N  P cttcccccggactactggagctcctacgacggtgaatcttcgccgcaggagagcactctt
 L  P  P  D  Y  W  S  S  Y  D  G  E  S  S  P  Q  E  S  T  L gtttatgaatgggacgagccggtttctctaaatggtgtgcgcatggttttcttctccgat
 V  Y  E  W  D  E  P  V  S  L  N  G  V  R  M  V  F  F  S  D cagcccgccggcgccgacgtcggtgtaccgccgccgtccagctggcatgtggagttcaag
 Q  P  A  G  A  D  V  G  V  P  P  P  S  S  W  H  V  E  F  K aactcagacggcgcatgggaaccagtttccaactcgacggcatatccgctcgacgttact
 N  S  D  G  A  W  E  P  V  S  N  S  T  A  Y  P  L  D  V  T gatgacccagaagaggtctcatttgctgaaatcaacacggtttccatccgagccatattg
 D  D  P  E  E  V  S  F  A  E  I  N  T  V  S  I  R  A  I  L ggtgcgtcaggaagtggagagcaatacggcggtgtggcggtaaaggagtgggaagcattg
 G  A  S  G  S  G  E  Q  Y  G  G  V  A  V  K  E  W  E  A  L gcgccaaacgccgaataa
 A  P  N  A  E  -

SEQ ID NO: 315
LENGTH: 505
TYPE: PRT
ORGANISM: M. phaseolina
MHLLVLLLSAAAASAQSSSITFNSSGNPILADGSYYSADPAPLVVNNTLYIIAGHDEAPVDQNAFIINEWELF

VSASPDPSGGEWTFYPGLARPHEIFSWAAQGTAYAAQIVQGPDDKFYLYAPVTEADSKNSDPFAIGVAVSDSP

LGPWTDAHPSGPVFSQSVPAPGNSIQNIDPTILVDDDQKVYVFYGTFGQLRAYEMADDMVTPASNVTIIDTLT

GFFEAPWVMKRNGTYYMLYAANNAGPESPCTPTSYHACIAYGTASSPLGPWTFRGVVLGIVSSTTSHPGAVEV

GGEWFIVYHTADAEGGGHFRRSVALDRLTFDDAQSPPAINKVVQTKRPQPAPAPTRNIAPKGKAASVRGTPIQ

YWVESLHDGEIPANPLPPDYWSSYDGESSPQESTLVYEWDEPVSLNGVRMVFFSDQPAGADVGVPPPSSWHVE

FKNSDGAWEPVSNSTAYPLDVTDDPEEVSFAEINTVSIRAILGASGSGEQYGGVAVKEWEALAPNAE*

SEQ ID NO: 316
LENGTH: 1570 (including 150 bp 5' UTR and 150 bp 3' UTR)
TYPE: DNA
ORGANISM: M. phaseolina
TCCGCCCACATAGTCGGTTCCGGTTAATGCGGTCGTGCAATGGACAGCTCGCAGGCGGCTTAAAACGGTTGCA

TGGCCGCGCCGCACGCTTCCCCCTCTCCTCCCTCCCCTCCTCCCGCGCCCGGCAACTCGCCGTACCGTCGAGT

TGCAATGCCCGCTCTACTCTTCCTCCTGCCGCTCCTTGCGAGCTACGCTGCTGCCCAGTACAAGGGGACATTC

GACGGCTCTGCAGCACTGCTTCGTTCCCGCCAGTCCGCCAACACTAGCGGCGCCACCTTCACGAACCCCATTC

TGGACGACGTGGGCGCGGACCCGTGGGTTTTCCGTCACAATGACTACTACTGTGGGTGTTTGAAAATGGAACT

GCCGGGAGCAGGTACCGTATGCAAATGCTAATTTCCATCCAAGACCTCATGTACACGAACTCGGTCAACATTA

CCCTCTTGCGCACTACCATCTTGACCGACTGGAACACTGCCGAGTCCCGTCTGCTCTTCCAGCCGCCTGCGGG

CACCAACTACTCCACCAACCTGTGGGCTCCCGAGCTGCACCAACTCGACGGCAACTGGTATGTCATCTTCACC

GCCGATCCTAACAACGACAGTCCGCCTCCCGAGGTCGACATGTATTGTGATTTCAACTGTCCTGCGTTCTTTC
```

-continued

ATCGCATGTGAGTCGATTGTTCCCTCACAGATCAAGAGCATTTCTAGAACACCATTGTTCCAGGTACGTCTTG

GAGGGCCTCGGAGACGACCCGTGGGAGGCCAGCTTCACCTTCAAGGCCGAGCTCAATACGTTCGACCAATTCG

CCATCGACGGGACCTACTTCCAGCACTCAACCGGCCTCTACCACGTCTACTCGTGCTGGATCCGGCAGTACGA

CGCGTGGCCCGCCAACCTGTGCATCACGGCCATGAGCAACCCGTGGACCGTGTCGTCCAACATCTCGGAGCGC

CAGGTTATCAGCATGCCGACGAATCCGTGGGAGAAGACGCCGTACGGCCGCCCGTTCAACGACCGCCTCAGCT

CCAACGAGGGGCCGCAGCAGCTCACTAACCCTACCACCAACCAGACCTTCCTCATCTACAGCGCCGCCCGCTC

CGACAACCGCAACTACTGCCTCGGCCAGCTCGAGCTCGTCGGCGACGACCCCATGAACCCCCAGGACTGGCGC

AAGAACAACGACGGCTGCGTCTTCTACCAGGACGCTCGCAACCAGGCTTACGGCGTCGGCCATGCCAGCTTCA

CCAAGAGCCCGGATGGCACCGAGGACTGGATCGTGTATCATGGCATGCGCAACCCGATCACAGGGTGGGCGGC

GAGGACGATTCGTGCGCAGAAGTTTGAGTGGAATGGGGACGGCAGTCCAGCTTTCCCGAGGCCCGGGTATGGG

CCTTATCCCGTGCCCGCTGGACAACAGTCGTGAGTTTGGTGGCCGTTTGCTTTAGGAGACGGGGCCGCAAAAA

AAGGGCTGAGGCTTAAATCGCCCGCGGAGAATGATGAGCCACCAGACTATATGCTCTAGTGCAGTCTCGACAT

TATCTGAAGAGGTTGCGTTCTGGATATACCTTTCCCA

```
SEQ ID NO: 317
LENGTH: 1149
TYPE: DNA
ORGANISM: M. phaseolina
FEATURE NAME/KEY: CDS
LOCATION: (1)...(1149)
atgcccgctctactcttcctcctgccgctccttgcgagctacgctgctgcccagtacaag
 M   P   A   L   L   F   L   L   P   L   L   A   S   Y   A   A   A   Q   Y   K gggacattcgacggctctgcagcactgcttcgttcccgccagtccgccaacactagcggc
 G   T   F   D   G   S   A   A   L   L   R   S   R   Q   S   A   N   T   S   G gccaccttcacgaaccccattctggacgacgtgggcgcggacccgtgggttttccgtcac
 A   T   F   T   N   P   I   L   D   D   V   G   A   D   P   W   V   F   R   H aatgactactactacctcatgtacacgaactcggtcaacattaccctcttgcgcactacc
 N   D   Y   Y   Y   L   M   Y   T   N   S   V   N   I   T   L   L   R   T   T atcttgaccgactggaacactgccgagtcccgtctgctcttccagccgcctgcgggcacc
 I   L   T   D   W   N   T   A   E   S   R   L   L   F   Q   P   P   A   G   T aactactccaccaacctgtgggctcccgagctgcaccaactcgacggcaactggtatgtc
 N   Y   S   T   N   L   W   A   P   E   L   H   Q   L   D   G   N   W   Y   V atcttcaccgccgatcctaacaacgacagtccgcctcccgaggtcgacatgtattgtgat
 I   F   T   A   D   P   N   N   D   S   P   P   P   E   V   D   M   Y   C   D ttcaactgtcctgcgttctttcatcgcatgtacgtcttggagggcctcggagacgacccg
 F   N   C   P   A   F   F   H   R   M   Y   V   L   E   G   L   G   D   D   P tgggaggccagcttcaccttcaaggccgagctcaatacgttcgaccaattcgccatcgac
 W   E   A   S   F   T   F   K   A   E   L   N   T   F   D   Q   F   A   I   D gggacctacttccagcactcaaccggcctctaccacgtctactcgtgctggatccggcag
 G   T   Y   F   Q   H   S   T   G   L   Y   H   V   Y   S   C   W   I   R   Q tacgacgcgtggcccgccaacctgtgcatcacggccatgagcaacccgtggaccgtgtcg
 Y   D   A   W   P   A   N   L   C   I   T   A   M   S   N   P   W   T   V   S tccaacatctcggagcgccaggttatcagcatgccgacgaatccgtgggagaagacgccg
 S   N   I   S   E   R   Q   V   I   S   M   P   T   N   P   W   E   K   T   P tacggccgcccgttcaacgaccgcctcagctccaacgaggggccgcagcagctcactaac
 Y   G   R   P   F   N   D   R   L   S   S   N   E   G   P   Q   Q   L   T   N cctaccaccaaccagaccttcctcatctacagcgccgcccgctccgacaaccgcaactac
 P   T   T   N   Q   T   F   L   I   Y   S   A   A   R   S   D   N   R   N   Y tgcctcggccagctcgagctcgtcggcgacgaccccatgaacccccaggactggcgcaag
 C   L   G   Q   L   E   L   V   G   D   D   P   M   N   P   Q   D   W   R   K aacaacgacggctgcgtcttctaccaggacgctcgcaaccaggcttacggcgtcggccat
 N   N   D   G   C   V   F   Y   Q   D   A   R   N   Q   A   Y   G   V   G   H
```

-continued

```
gccagcttcaccaagagcccggatggcaccgaggactggatcgtgtatcatggcatgcgc
 A  S  F  T  K  S  P  D  G  T  E  D  W  I  V  Y  H  G  M  R aacccgatcacagggtgggcggcgaggacgattcgtgcgcagaagtttgagtggaatggg
 N  P  I  T  G  W  A  A  R  T  I  R  A  Q  K  F  E  W  N  G gacggcagtccagcttttcccgaggcccgggtatgggccttatcccgtgcccgctggacaa
 D  G  S  P  A  F  P  R  P  G  Y  G  P  Y  P  V  P  A  G  Q cagtcgtga
 Q  S  -
```

SEQ ID NO: 318
LENGTH: 382
TYPE: PRT
ORGANISM: M. phaseolina

MPALLFLLPLLASYAAAQYKGTFDGSAALLRSRQSANTSGATFTNPILDDVGADPWVFRHNDYYYLMYTNSVN

ITLLRTTILTDWNTAESRLLFQPPAGTNYSTNLWAPELHQLDGNWYVIFTADPNNDSPPPEVDMYCDFNCPAF

FHRMYVLEGLGDDPWEASFTFKAELNTFDQFAIDGTYFQHSTGLYHVYSCWIRQYDAWPANLCITAMSNPWTV

SSNISERQVISMPTNPWEKTPYGRPFNDRLSSNEGPQQLTNPTTNQTFLIYSAARSDNRNYCLGQLELVGDDP

MNPQDWRKNNDGCVFYQDARNQAYGVGHASFTKSPDGTEDWIVYHGMRNPITGWAARTIRAQKFEWNGDGSPA

FPRPGYGPYPVPAGQQS*

SEQ ID NO: 319
LENGTH: 1785 (including 150 bp 5' UTR and 150 bp 3' UTR)
TYPE: DNA
ORGANISM: M. phaseolina

TGATCGCCGCGCCGCCGCCGCAGCAGACCCGGAACCGGCCACTCTGGAGAGCTGGACGCTCGCCGCAGGGTTC

GCTCGTATTTGTACGACCTGCTCCGCCGACAAGCTTCGTCGCGTCTTCCTCCCCGAAACTCTATTCGACCCGG

CATCATGACTTACAACAACTCGCTCATCACCTGCACTCCCCATGCCACTCCCGACCCCTTCGTCACCCACGCC

AATGGCAAGTTCTACTTGGTATGCACGCCCCGCCTTTCAGCGAGGCGGAGCGGTAGCTCTGCGGGGCTCCGTC

CCGCATTCCCCGCTCACCAGTTAAGATCGCTGACTTCTTTCTAGACCTTCACTGCCGGTGACCGCGTCGAGGT

CTGGTGCTCCGACAACGTGCTCAGCTTCCACAATGCCTCCAAGCATGTCATTTGGTAGGTGGgCcTTttCTTT tCTTTTCTTCTTTTtCCCTttCCTCTCTCTCTCTCTCTCTTCACCCCTCAATCAAGTCGTTGGTTCTTTTC

CCTCCATGTATTTCATTATTTCACTACCTTCTCTTCATCCGCACCCTGAGCGTGATCCGTCCACGCTCTCGCT

CCCTATTCTTCTTCACTCTCCTTCGAATTCGCCGTGCTGACGCCCACCAGGAAGCCCCCGCCAGGCACCGAGT

ACTCCGGCGGCATCTGGGCTCCCGAAATCCACGTCGTAGACGGCCGCTGGTACTGCTATGTCGCCTGCGAGGA

CCCCAAGCACGGCAACAAGTCTCACAGGGCACGTTCCAGCACCATCAGTCCCAAAAGAAACCTCCCACTAACC

TGCCCTCCAGATCTACGTCATCGGCGGGCCTCCCGGCCACGAAGACCCCTGCCACGGACAGTGGGAGTTCCTG

GGCCGCCTGCGCGGCCTCCCGCACGACCAATGGGCCATCGACGGCACCGTCGTCCACCTCAACAACCAAAAGT

ACTTCATCTACAGCGGCTGGCCGCTCGGCGAGCTCAACTCCGACAAGACCCAGGAGCTCTTCATCGTGCGGCT

GCTCAGCCCCGTTGAAGCCGACGCCTCGCGCCCGCCCGTCAAGATCTCGCACCCGGACTACCGTGGGAGCGC

AGCGGGCCGAGCGGCATCAACGAGGGCCCGCAGTACCTCGCCTCGCCCGACGGCTCCTGGATCGGCATCGCGT

ACAGCTGCGCGGGCTCGTGGACGCGCGACTACAAGATGAACACGATCCGCTACGACCCGAGCCACGACCCGCT

CGACCCGCGCGCCTGGCGCAAGAGCGACAAGCCGCTCATCTGCGCCCCCGACAGCGACGCCTGCGGGCCCTAC

GGCCCCGGCCACGGCAACTTCGTCCCCATCCGCGACGACGAGATCCTCGCCGTCTTCCACGCCACCGACAGCC

CCACCGACGGCTGGGAGAACCGCAAGGGCCGCTGCCAGCGCGTCAACTGGACCAGGAACGGCCCCGACATGGG

CAACTGCTGCGGCCCCGTCTGCAATAGCGTTGAAGATTTCATGAAGGGCGGGCATGCGCAGGCTTGGAATGGC

GCCGGCAGCCACGGAGGCGGCGCCGGCAGTCTGGAGGACAAGCTGCACGGCTTCCTGAACAAGGCTAAGGACA

AGGTCGAGCAGAAGCTCAGGGAGTTGTAAAATCCGAAGTTTTtAAAGGAaAAAaAAAAAAAAAAaCGAGAAAA

AGAAGAGAGGGTATTCTCCCTTTTCCGTAGCATTGTATGATATTATACATTTGAGCGCGGCACCGACCTCTAG

GCCGGCTTTTGCGATAACGAACCATATATAATA

```
SEQ ID NO: 320
LENGTH: 1116
TYPE: DNA
ORGANISM: M. phaseolina
FEATURE NAME/KEY: CDS
LOCATION: (1)...(1116)
atgacttacaacaactcgctcatcacctgcactcccatgccactcccgacccttcgtc
 M  T  Y  N  N  S  L  I  T  C  T  P  H  A  T  P  D  P  F  V acccacgccaatggcaagttctacttgaccttcactgccggtgaccgcgtcgaggtctgg
 T  H  A  N  G  K  F  Y  L  T  F  T  A  G  D  R  V  E  V  W tgctccgacaacgtgctcagcttccacaatgcctccaagcatgtcatttggaagcccccg
 C  S  D  N  V  L  S  F  H  N  A  S  K  H  V  I  W  K  P  P ccaggcaccgagtactccggcggcatctgggctcccgaaatccacgtcgtagacggccgc
 P  G  T  E  Y  S  G  G  I  W  A  P  E  I  H  V  V  D  G  R tggtactgctatgtcgcctgcgaggaccccaagcacggcaacaagtctcacaggatctac
 W  Y  C  Y  V  A  C  E  D  P  K  H  G  N  K  S  H  R  I  Y gtcatcggcgggcctcccggccacgaagaccctgccacggacagtggggagttcctgggc
 V  I  G  G  P  P  G  H  E  D  P  C  H  G  Q  W  E  F  L  G cgcctgcgcggcctcccgcacgaccaatgggccatcgacggcaccgtcgtccacctcaac
 R  L  R  G  L  P  H  D  Q  W  A  I  D  G  T  V  V  H  L  N aaccaaaagtacttcatctacagcggctggccgctcggcgagctcaactccgacaagacc
 N  Q  K  Y  F  I  Y  S  G  W  P  L  G  E  L  N  S  D  K  T caggagctcttcatcgtgcggctgctcagccccgttgaagccgacgcctcgcgcccgccc
 Q  E  L  F  I  V  R  L  L  S  P  V  E  A  D  A  S  R  P  P gtcaagatctcgcacccggactaccccgtgggagcgcagcgggccgagcggcatcaacgag
 V  K  I  S  H  P  D  Y  P  W  E  R  S  G  P  S  G  I  N  E ggcccgcagtacctcgcctcgcccgacggctcctggatcggcatcgcgtacagctgcgcg
 G  P  Q  Y  L  A  S  P  D  G  S  W  I  G  I  A  Y  S  C  A ggctcgtggacgcgcgactacaagatgaacacgatccgctacgacccgagccacgacccg
 G  S  W  T  R  D  Y  K  M  N  T  I  R  Y  D  P  S  H  D  P ctcgacccgcgcgcctggcgcaagagcgacaagccgctcatctgcgcccccgacagcgac
 L  D  P  R  A  W  R  K  S  D  K  P  L  I  C  A  P  D  S  D gcctgcgggccctacggccccggccacggcaacttcgtccccatccgcgacgacgagatc
 A  C  G  P  Y  G  P  G  H  G  N  F  V  P  I  R  D  D  E  I ctcgccgtcttccacgccaccgacagccccaccgacggctgggagaaccgcaagggccgc
 L  A  V  F  H  A  T  D  S  P  T  D  G  W  E  N  R  K  G  R tgccagcgcgtcaactggaccaggaacggccccgacatgggcaactgctgcggccccgtc
 C  Q  R  V  N  W  T  R  N  G  P  D  M  G  N  C  C  G  P  V tgcaatagcgttgaagatttcatgaagggcgggcatgcgcaggcttggaatggcgccggc
 C  N  S  V  E  D  F  M  K  G  G  H  A  Q  A  W  N  G  A  G agccacggaggcggcgccggcagtctggaggacaagctgcacggcttcctgaacaaggct
 S  H  G  G  G  A  G  S  L  E  D  K  L  H  G  F  L  N  K  A aaggacaaggtcgagcagaagctcagggagttgtaa
 K  D  K  V  E  Q  K  L  R  E  L  -

SEQ ID NO: 321
LENGTH: 371
TYPE: PRT
ORGANISM: M. phaseolina
MTYNNSLITCTPHATPDPFVTHANGKFYLTFTAGDRVEVWCSDNVLSFHNASKHVIWKPPPGTEYSGGIWAPE

IHVVDGRWYCYVACEDPKHGNKSHRIYVIGGPPGHEDPCHGQWEFLGRLRGLPHDQWAIDGTVVHLNNQKYFI

YSGWPLGELNSDKTQELFIVRLLSPVEADASRPPVKISHPDYPWERSGPSGINEGPQYLASPDGSWIGIAYSC

AGSWTRDYKMNTIRYDPSHDPLDPRAWRKSDKPLICAPDSDACGPYGPGHGNFVPIRDDEILAVFHATDSPTD

GWENRKGRCQRVNWTRNGPDMGNCCGPVCNSVEDFMKGGHAQAWNGAGSHGGGAGSLEDKLHGFLNKAKDKVE

QKLREL*
```

-continued

SEQ ID NO: 322
LENGTH: 1754 (including 150 bp 5' UTR and 150 bp 3' UTR)
TYPE: DNA
ORGANISM: M. phaseolina
CAAGCGGGCGGTTGGAAGGACCATGGCGTTACTATAAGACGTCCTCGGCTTCCCTGTTCCTGGCCCAGGTACC

TCGTCCATTACCGAGCTCCCTGTTCCCTGGCCGATCGACCTCTTTCTCGCCTTTCGTCTGAGCCTTTTTCACG

GAGCATGTTTTTCTCTAGCTTGTTCGCCGCGTCGCTGGCGGCGTTGGCCCAGTTGGCTGCGGCCGCGAATTAC

TCGAACCCCCTCCGGCAGACCGATGGCAGTGATCCTCAGATCGTCTGGCACGATGGATACTATTATCTGATGA

CGACGACCTGGACAGACGTCCAGCTTACGAGGGCCACGACCCTTGAGGGATTGAAGACCGGTGAGAGGAAGAC

AGTGTGGGTGGATGAGGACCCATCCCGGTGCTGCAGTGTCTGGGCTCCTGGTATGTGAATACTTGTTTCATTT

GAGCTTAAAGTCGTGCCCATCACTATTCTCTCTTTCCATCAGAACTGCACATCATGGCAGTCGTTTGTTTTGT

CGGCGCCGCACAAAAGACGGGATACGAGGCCAAAGTGACTGGCCTAGCAGCTGGTtACAGTCACTATACTGAA

CTGCACGTCCACTCATACCCAGCCAGACGGGCTAGCGCAATCTTGAGAGGAGGAGCTGCTGAATCCACTGCTT

GATGAGCTCCGTGGAAAATGTTTAATTGATCGGGATGCCGTACATGGACCTCTTTGTTTTCATTTATCGTTGT

GCACTTTGTCAATCAATTGCTGACGCTTTGATAGAACTGCACGAGCTCGACGGAACTTGGTACATTTACTATA

CTGCCGGCACCGCGGAGAACCTCGATGGCCAGCGTCCTCAAGTCCTTGAAGGTAAATTACAAATAGCCATCCG

AAGAAGAACAACCCACTAATCACTCCGCGCAGGCGGTGCTCACCCTTGGGATGACGACTACGCCTGGGTTGCC

ACCCTGACGTCCACCTGGGGCATCGACGGATCCGTCGCCACCATTGACAACCAACGCTACTTCACCTGGTCCT

GCTTCGACGGCACCGATATCCAATCCCTCTGCATTGCCTCCATGACCTCACCTACCTCGCTCGGCCCCACCGT

CCTGATCTCCGAGCCCACCGAAGACTGGTAAAAAGCCCCTCCACCCCCTCTCACCAGCACCAAACCCCCACTA

ACCCACCACTCCCAGGGAAATTGTCGGCGCTCCCGTCAACGAAGGCCCCTACCTCCTCCAAAGCCCAGTCAGC

GGCACCTACTACATTGTCTTCTCCGCCTCCTACTGCTGGACCACCTCCTACCAGCTCGGCTTGCTCACGCTGG

CCTCCGGCGCCGACCCGCTGGTCCGCGAGTCCTGGACCAAGTCCGGCCCGGTCTTCTCGTCCGCCAACGGCAA

CCTAGGGACGGCGCACAACGCCTTCTTCACCTCGCCCGACGGCACCGAGACGTGGAACGTGTATCACGCGACG

GCCAACGCGAACGGCGCGTGCGATGGCAATCGGTACACCAGCGTCGATAGGGTGAGTTGGCGGGAGGATGGCA

GTCCGGATTTCGGCGTCGCCAGCGCGCTGGGGGTTGTGCTGCAGGGGCCCGCTGGGGAGCCGGATGCGTGAGC

GACGGGCCGTTGTGGATTCTTCGGTGAATTTTCGTTCTGAGCGTTATGGTAGGATGATGAAAATTTATGAATT

CAAGCTTTCAAGGTTGTACGATGAATGCCGTTTCCGCGAGGAGTAAAAAAAaGGCCAAACGCATGCCCATTTG

CT

SEQ ID NO: 323
LENGTH: 990
TYPE: DNA
ORGANISM: M. phaseolina
FEATURE NAME/KEY: CDS
LOCATION: (1)...(990)
atgttttctctagcttgttcgccgcgtcgctggcggcgttggcccagttggctgcggcc
 M  F  F  S  S  L  F  A  A  S  L  A  A  L  A  Q  L  A  A  A gcgaattactcgaaccccctccggcagaccgatggcagtgatcctcagatcgtctggcac
 A  N  Y  S  N  P  L  R  Q  T  D  G  S  D  P  Q  I  V  W  H gatggatactattatctgatgacgacgacctggacagacgtccagcttacgagggccacg
 D  G  Y  Y  Y  L  M  T  T  T  W  T  D  V  Q  L  T  R  A  T acccttgagggattgaagaccggtgagaggaagacagtgtgggtggatgaggacccatcc
 T  L  E  G  L  K  T  G  E  R  K  T  V  W  V  D  E  D  P  S cggtgctgcagtgtctgggctcctgaactgcacgagctcgacggaacttggtacatttac
 R  C  C  S  V  W  A  P  E  L  H  E  L  D  G  T  W  Y  I  Y tatactgccggcaccgcggagaacctcgatggccagcgtcctcaagtccttgaaggcggt
 Y  T  A  G  T  A  E  N  L  D  G  Q  R  P  Q  V  L  E  G  G gctcacccttgggatgacgactacgcctgggttgccaccctgacgtccacctggggcatc
 A  H  P  W  D  D  D  Y  A  W  V  A  T  L  T  S  T  W  G  I -continued

```
gacggatccgtcgccaccattgacaaccaacgctacttcacctggtcctgcttcgacggc
 D   G   S   V   A   T   I   D   N   Q   R   Y   F   T   W   S   C   F   D   G accgatatccaatccctctgcattgcctccatgacctcacctacctcgctcggccccacc
 T   D   I   Q   S   L   C   I   A   S   M   T   S   P   T   S   L   G   P   T gtcctgatctccgagcccaccgaagactgggaaattgtcggcgctcccgtcaacgaaggc
 V   L   I   S   E   P   T   E   D   W   E   I   V   G   A   P   V   N   E   G ccctacctcctccaaagcccagtcagcggcacctactacattgtcttctccgcctcctac
 P   Y   L   L   Q   S   P   V   S   G   T   Y   Y   I   V   F   S   A   S   Y tgctggaccacctcctaccagctcggcttgctcacgctggcctccggcgccgacccgctg
 C   W   T   T   S   Y   Q   L   G   L   L   T   L   A   S   G   A   D   P   L gtccgcgagtcctggaccaagtccggcccggtcttctcgtccgcaacggcaacctaggg
 V   R   E   S   W   T   K   S   G   P   V   F   S   S   A   N   G   N   L   G acggcgcacaacgccttcttcacctcgcccgacggcaccgagacgtggaacgtgtatcac
 T   A   H   N   A   F   F   T   S   P   D   G   T   E   T   W   N   V   Y   H gcgacggccaacgcgaacggcgcgtgcgatggcaatcggtacaccagcgtcgatagggtg
 A   T   A   N   A   N   G   A   C   D   G   N   R   Y   T   S   V   D   R   V agttggcgggaggatggcagtccggatttcggcgtcgccagcgcgctggggttgtgctg
 S   W   R   E   D   G   S   P   D   F   G   V   A   S   A   L   G   V   V   L caggggcccgctggggagccggatgcgtga
 Q   G   P   A   G   E   P   D   A   -
```

SEQ ID NO: 324
LENGTH: 329
TYPE: PRT
ORGANISM: M. phaseolina
MFFSSLFAASLAALAQLAAAANYSNPLRQTDGSDPQIVWHDGYYYLMTTTWTDVQLTRATTLEGLKTGERKTV

WVDEDPSRCCSVWAPELHELDGTWYIYYTAGTAENLDGQRPQVLEGGAHPWDDDYAWVATLTSTWGIDGSVAT

IDNQRYFTWSCFDGTDIQSLCIASMTSPTSLGPTVLISEPTEDWEIVGAPVNEGPYLLQSPVSGTYYIVFSAS

YCWTTSYQLGLLTLASGADPLVRESWTKSGPVFSSANGNLGTAHNAFFTSPDGTETWNVYHATANANGACDGN

RYTSVDRVSWREDGSPDFGVASALGVVLQGPAGEPDA*

SEQ ID NO: 325
LENGTH: 1463 (including 150 bp 5' UTR and 150 bp 3' UTR)
TYPE: DNA
ORGANISM: M. phaseolina
CTCGACTCCTGGCTTTACCATGGGCTGATTCGCGGAACTGCAAAGGCAGACTAACCTGCGTCCACGGGTGACT

GCTCTGCCCGGATACCATTTCACTCAACCTTGGCGTCCATATAAAGAGGTGCGAATCGCCTCCTTCTTGAGCA

AGACATGCGCGTCGCTCTTCCTACCATATCGGACAGCATGAGACCGTTCGCTTCGCTGATTTGCTGGGTCTTC

TGGGCTCAGGCTCACCTTGTCGGAGCCGCAACTTTTTCCAACCCACTCAAGAACCCCAATGGCTCCGATCCGC

ACATCGTGTGGTCTGGTGGTTACTACTATTTAATGACAACCACATGGACCAATCTGCAAATCACGCGCGCGAC

GACCTTGAACGGTCTGAAGACGGGAGAGACGAAGACGGTGTGGACGGATACAAACTCGGCGCGTTGCTGCAAT

GTGTGGGCTCCGGAGCTCCATTACTTTGACGGAACGTCAGTCACTCAGTTCAATTCATGCCAATCTGCTCAAG

TTACTTACCCAGAGCACAGCTGGTACATTTACTACACTGCCGGAAACAGCGCGAACCTGGACGGCCAGCGACC

TCATGTGCTCAAGGGTAAGCCCCGGAAATCAAAGTCCATGGACAAGAGATCCTAACAGAGCTTCTAGGCGGCG

CCACTCCGTGGGACAGCTGGAGCTATCTCGCGCAGCTCACCACTACCTGGGGCATCGACGGCACCATCCTCCG

CTTCACCTCCGGCAATTACTTCGTCTTCTCCTGCATGAGCAATAGCCTTCAATCCCTGTGCATCGCCCCGCTC

AACTCCCCCGGCAGCATTGGCAGCATCAAGGTCCTCTCCCAGCCCACCGCCTCCTGGGAGACCGTCGGCGCCC

CCGTGCAAGAGGGCCCCGCGGCCATGTACCATGGCGGCAAGACGTACCTGACCTATTCCGCCAGCTACTGCTG

GACCTCCAGCTACCAACTCGGGCTGCTGACCTGGAACGGCGGCGATCCTACGTCGTCGAGCAGCTGGGTGAAG

ACGGGGCCGGTATTCAAGTCGGCGAATGGAAATTATGGAACGGGCCACAACGGGTATGCATCTCCGCCAGTCC

TTCTTGATGAAAGGTCTCTGACAGGAAACAGGTTCTTCCAAAGCCCCGATGGCACGGAGATCTGGAATGTGTA

CCACGCGACCTCCAACAGCGGCGGCGGGTGCGACGGCAACAGGTATACGATGGCGCAGAAGGTCAACTGGAAC

-continued

```
TCGGACGGATCGCCTAATTTCGGCACTGCAGCTGCTCTGGGCACGACACTTGCGGGGCCTTCTGGAGAGTAGT

TTAGTTCATCCAGCCGTAATTCTGGCGGAGCGGACTGGAATGGATAGCAAAGGAGAGAGGATAAAAACAATTC

TCGGAATCAAGCCCGAAAACAAAATAGATAGACCTTTCTCGCCTGCGGGAGTCTTTCTCCAATGCCAATATCC

ATT

SEQ ID NO: 326
LENGTH: 1002
TYPE: DNA
ORGANISM: M. phaseolina
FEATURE NAME/KEY: CDS
LOCATION: (1)...(1002)
atgcgcgtcgctcttcctaccatatcggacagcatgagaccgttcgcttcgctgatttgc
  M   R   V   A   L   P   T   I   S   D   S   M   R   P   F   A   S   L   I   C tgggtcttctgggctcaggctcaccttgtcggagccgcaactttttccaacccactcaag
  W   V   F   W   A   Q   A   H   L   V   G   A   A   T   F   S   N   P   L   K aaccccaatggctccgatccgcacatcgtgtggtctggtggttactactatttaatgaca
  N   P   N   G   S   D   P   H   I   V   W   S   G   G   Y   Y   Y   L   M   T accacatggaccaatctgcaaatcacgcgcgcgacgaccttgaacggtctgaagacggga
  T   T   W   T   N   L   Q   I   T   R   A   T   T   L   N   G   L   K   T   G gagacgaagacggtgtggacggatacaaactcggcgcgttgctgcaatgtgtgggctccg
  E   T   K   T   V   W   T   D   T   N   S   A   R   C   C   N   V   W   A   P gagctccattactttgacggaacctggtacatttactacactgccggaaacagcgcgaac
  E   L   H   Y   F   D   G   T   W   Y   I   Y   Y   T   A   G   N   S   A   N ctggacggccagcgacctcatgtgctcaagggcggcgccactccgtgggacagctggagc
  L   D   G   Q   R   P   H   V   L   K   G   G   A   T   P   W   D   S   W   S tatctcgcgcagctcaccactacctggggcatcgacggcaccatcctccgcttcacctcc
  Y   L   A   Q   L   T   T   T   W   G   I   D   G   T   I   L   R   F   T   S ggcaattacttcgtcttctcctgcatgagcaatagccttcaatccctgtgcatcgccccg
  G   N   Y   F   V   F   S   C   M   S   N   S   L   Q   S   L   C   I   A   P ctcaactcccccggcagcattggcagcatcaaggtcctctcccagcccaccgcctcctgg
  L   N   S   P   G   S   I   G   S   I   K   V   L   S   Q   P   T   A   S   W gagaccgtcggcgcccccgtgcaagagggccccgcggccatgtaccatggcggcaagacg
  E   T   V   G   A   P   V   Q   E   G   P   A   A   M   Y   H   G   G   K   T tacctgacctattccgccagctactgctggacctccagctaccaactcgggctgctgacc
  Y   L   T   Y   S   A   S   Y   C   W   T   S   S   Y   Q   L   G   L   L   T tggaacggcggcgatcctacgtcgtcgagcagctgggtgaagacggggccggtattcaag
  W   N   G   G   D   P   T   S   S   S   S   W   V   K   T   G   P   V   F   K tcggcgaatggaaattatggaacgggccacaacgggttcttccaaagcccgatggcacg
  S   A   N   G   N   Y   G   T   G   H   N   G   F   F   Q   S   P   D   G   T gagatctggaatgtgtaccacgcgacctccaacagcggcggcggtgcgacggcaacagg
  E   I   W   N   V   Y   H   A   T   S   N   S   G   G   G   C   D   G   N   R tatacgatggcgcagaaggtcaactggaactcggacggatcgcctaatttcggcactgca
  Y   T   M   A   Q   K   V   N   W   N   S   D   G   S   P   N   F   G   T   A gctgctctgggcacgacacttgcggggccttctggagagtag
  A   A   L   G   T   T   L   A   G   P   S   G   E   -

SEQ ID NO: 327
LENGTH: 333
TYPE: PRT
ORGANISM: M. phaseolina
MRVALPTISDSMRPFASLICWVFWAQAHLVGAATFSNPLKNPNGSDPHIVWSGGYYYLMTTTWTNLQITRATT

LNGLKTGETKTVWTDTNSARCCNVWAPELHYFDGTWYIYYTAGNSANLDGQRPHVLKGGATPWDSWSYLAQLT

TTWGIDGTILRFTSGNYFVFSCMSNSLQSLCIAPLNSPGSIGSIKVLSQPTASWETVGAPVQEGPAAMYHGGK

TYLTYSASYCWTSSYQLGLLTWNGGDPTSSSSWVKTGPVFKSANGNYGTGHNGFFQSPDGTEIWNVYHATSNS

GGGCDGNRYTMAQKVNWNSDGSPNFGTAAALGTTLAGPSGE*
```

-continued

SEQ ID NO: 328
LENGTH: 2524 (including 150 bp 5' UTR and 150 bp 3' UTR)
TYPE: DNA
ORGANISM: M. phaseolina

CCCACCCGCCGGCTTCACCATCGCCGTGGCGTGCTCGTTCTTAGACGGCCGCAGACGCTGTTCACGAAAGCCT

AGCAGCCTGCATCCATCCACCCGTCAACCCAGCACATTCCCTCCTCACGCCAGGAACTGCCAATTCTCGCCCC

AGCCATGGCGACCTTCACCAAGATCTCCGAGAACGACACGCCCAGCATTTCCCTCAACCCCGCCCACAGGATC

TCCAAGATCAACGACAATGTTTATGGTGGATTTACCGAGTATGTGTGCCTGTGTCTCTCAGCCCGCCACTGGC

GATCGAGAACGGCATAGCTGCTTCCTATCACCGCCCTTTGCCCACCGCTGACCGTCCCGCTTCTGTCCCCTGC

CAGACACATGGGCCGCTGCATTTACGGCGGCATTTACGACCCTGGCAACCCGCTCTCCGACGAACACGGCTTC

CGCAAAGACGTCATTGAGGCCTTTCAGGAGCTTAACTGCCCCGTCGTCCGTTACCCCGGCGGCAATTTCGTCG

CTACCTACCACTGGCTCGATGGCGTTGGGCCCAAGGCCCAACGGCCTCCGAGGTAAGCCTGCTTGATTTCTAT

TCCCTTTTCCAGGTTTCTAAAATCTCCGGCAATCGTATTCATGCCGCTGCTCCGGCTACTGCCGTGCCGTTAC

TTGCATGCGGCTCTGCAGCTGACGGTGGTTGCCTCATCAGGCAACGATCGGTGTCGGCGCCGATTGCTGCCTT

GGTATTCTTTTCCCTTCACCACGCCTTCACGTGACGCCTACATTCGAGCTCGCCTTTATGCACAGCTGTAGCA

AGCTGCATAGGTGGAGTGGAGTTACATGTCGGGATATCTCGGGTCTCAGCGCTGCTCCGTCCATGCTCGCTTC

CCGAGCACTTCACACTTCACTGTGCTGTTGCCCCCGTCCCCGTAGTCCTGCTTGCCTTGCCTCTGCATGCTTC

CAACCCAAATTTTGGTCGCCATGGATGTGGACAGTCCACCGAAAATCACCGCACATGAATTGATGAACTGAAA

TCTTGATCATAGACCTGAGCTAGCATGGCTCGGCCTGGAAACCAACGAGTTCGGCACCGATGAGTTCCTCAAG

TGGTGCGAAGTCGTCGGAACCGAGCCCTACTTCGCCCTGAACTTTGGTACTGGAACGCTTGATGAAGGTCAGT

AGGAATATGGAATTCGTTGTCAGCCACGGCGGCGAGTAACTGACGGACACTAGCTCTCGGCTGGATCGAGTAC

TGCAACTCCTCGCAAAACACCTACTACGCCAACCTCCGTCGCAAGAATGGCCGCGAAAAGCCATACAACGTAT

GCCAAAGTCCTCTCCGCCGATGCCCTTTCCTTCACTGACAGCCACAATCCAGGTCAAATACTGGGCCTTGGGC

AACGAGATGTGGGGGCCCTGGCAAGTCGGCCAAATGACCAAGGAGGACTACGCGCACAAGGCCTACCAATGGG

CCAAGGCGATCAAGCTGCTCGACCCGTCCGTCGAGCTCATTCTCTGTGGCCAGGATGGCACTAGCACATGGGA

CACTTACGTGATCAAAGAGTGCATCCGCTGGGAGCCGCACGCGCTGGGCGGCTCGCAGACGGCGTCGCTCATC

GCCATGCACAGCATCCACATCTACACAGCCGCCCAGGAACACCTGCCCAACGCGACGGCGCCCCGCAGCGCTG

AGCGCGCCATCGAGATCACCGCCGGTCTCATCGACCTCGCCCGCGCCGAGAACAAGGTTCCCCATACCGCGCC

GCGCCCGACCATCTGCTTCGACGAGTGGAATGTCTGGGACCCCGTCCGCGCCCCCGGTGAGCTCGGGGCCGAG

GAGAAGTACACGCTGTCGGACGCCCTGGCTGTCGCCGTGTGGCTGAACGTCTTCATCCGCCAGAGCAAGCACG

TCGGCATGGCGAATATCGCCCAGAGCGTCAACGTTATCTCGCCGCTCATGACCAACAAAGACGGCCTCGTCAA

GCAGACCACCTGGTGGCCGCTGCTGCTGTTCAGCAAGTACATGCGCGGTCACACACTCGCCGTCAATGTTCGC

GCGGCGGAGTACGAGGGCCCCACGGCGCCCGCTTGGCTCAGAGGCACGATCGAGACGCCCTACTTGGATGTCT

CAGCTGCCATCACCGATGATGGATACGTTGGCCTGGCTGTGGTGAATGTGCATGAGAGCAAGGCCTTCGAGAC

TGATCTCGAGGGCGTCGTGAGTAAGGAGGGTGGCGTTAAGGTGTATACCGTTACGGGCTCTGGCTGGGAGGTA

GTCAACACGGAGTCGAAGCAGGAGGTCGGCATTAAAGAGAGCGATTGGGATGGAAAGGGCAAGTTTACATTCC

CGAAGTTGAGCTTTACGTTGTTGAGGTGGAAGGCCTAGGTTAGGGACGGTGTGGTGTGGCTATGGTTGCCTGA

GCATATAGATTTGTTCTCTGATAGAATCACAACTGCATCATGGTTTTGGCGTTTAAATCTATGCTACGCTCGC

AGATCTTTTACTTATGGCAACCAGTGCGCAAGGGGAGTTGAA

-continued

SEQ ID NO: 329
LENGTH: 1527
TYPE: DNA
ORGANISM: M. phaseolina
FEATURE NAME/KEY: CDS
LOCATION: (1)...(1527)

```
atggcgaccttcaccaagatctccgagaacgacacgcccagcatttccctcaaccccgcc
 M  A  T  F  T  K  I  S  E  N  D  T  P  S  I  S  L  N  P  A cacaggatctccaagatcaacgacaatgtttatggtggatttaccgaacacatgggccgc
 H  R  I  S  K  I  N  D  N  V  Y  G  G  F  T  E  H  M  G  R tgcatttacggcggcatttacgaccctggcaacccgctctccgacgaacacggcttccgc
 C  I  Y  G  G  I  Y  D  P  G  N  P  L  S  D  E  H  G  F  R aaagacgtcattgaggcctttcaggagcttaactgccccgtcgtccgttaccccggcggc
 K  D  V  I  E  A  F  Q  E  L  N  C  P  V  V  R  Y  P  G  G aatttcgtcgctacctaccactggctcgatggcgttgggcccaaggcccaacggcctccg
 N  F  V  A  T  Y  H  W  L  D  G  V  G  P  K  A  Q  R  P  P agacctgagctagcatggctcggcctggaaaccaacgagttcggcaccgatgagttcctc
 R  P  E  L  A  W  L  G  L  E  T  N  E  F  G  T  D  E  F  L aagtggtgcgaagtcgtcggaaccgagccctacttcgccctgaactttggtactggaacg
 K  W  C  E  V  V  G  T  E  P  Y  F  A  L  N  F  G  T  G  T cttgatgaagctctcggctggatcgagtactgcaactcctcgcaaaacacctactacgcc
 L  D  E  A  L  G  W  I  E  Y  C  N  S  S  Q  N  T  Y  Y  A aacctccgtcgcaagaatggccgcgaaaagccatacaacgtcaaatactgggccttgggc
 N  L  R  R  K  N  G  R  E  K  P  Y  N  V  K  Y  W  A  L  G aacgagatgtgggggccctggcaagtcggccaaatgaccaaggaggactacgcgcacaag
 N  E  M  W  G  P  W  Q  V  G  Q  M  T  K  E  D  Y  A  H  K gcctaccaatgggccaaggcgatcaagctgctcgacccgtccgtcgagctcattctctgt
 A  Y  Q  W  A  K  A  I  K  L  L  D  P  S  V  E  L  I  L  C ggccaggatggcactagcacatgggacacttacgtgatcaaagagtgcatccgctgggag
 G  Q  D  G  T  S  T  W  D  T  Y  V  I  K  E  C  I  R  W  E ccgcacgcgctgggcggctcgcagacggcgtcgctcatcgccatgcacagcatccacatc
 P  H  A  L  G  G  S  Q  T  A  S  L  I  A  M  H  S  I  H  I tacacagccgcccaggaacacctgcccaacgcgacggcgccccgcagcgctgagcgcgcc
 Y  T  A  A  Q  E  H  L  P  N  A  T  A  P  R  S  A  E  R  A atcgagatcaccgccggtctcatcgacctcgcccgcgccgagaacaaggttccccatacc
 I  E  I  T  A  G  L  I  D  L  A  R  A  E  N  K  V  P  H  T gcgccgcgcccgaccatctgcttcgacgagtggaatgtctgggacccgtccgcgccccc
 A  P  R  P  T  I  C  F  D  E  W  N  V  W  D  P  V  R  A  P ggtgagctcggggccgaggagaagtacacgctgtcggacgccctggctgtcgccgtgtgg
 G  E  L  G  A  E  E  K  Y  T  L  S  D  A  L  A  V  A  V  W ctgaacgtcttcatccgccagagcaagcacgtcggcatggcgaatatcgcccagagcgtc
 L  N  V  F  I  R  Q  S  K  H  V  G  M  A  N  I  A  Q  S  V aacgttatctcgccgctcatgaccaacaaagacggcctcgtcaagcagaccacctggtgg
 N  V  I  S  P  L  M  T  N  K  D  G  L  V  K  Q  T  T  W  W ccgctgctgctgttcagcaagtacatgcgcggtcacacactcgccgtcaatgttcgcgcg
 P  L  L  L  F  S  K  Y  M  R  G  H  T  L  A  V  N  V  R  A gcggagtacgagggccccacggcgcccgcttggctcagaggcacgatcgagacgccctac
 A  E  Y  E  G  P  T  A  P  A  W  L  R  G  T  I  E  T  P  Y ttggatgtctcagctgccatcaccgatgatggatacgttggcctggctgtggtgaatgtg
 L  D  V  S  A  A  I  T  D  D  G  Y  V  G  L  A  V  V  N  V catgagagcaaggccttcgagactgatctcgagggcgtcgtgagtaaggagggtggcgtt
 H  E  S  K  A  F  E  T  D  L  E  G  V  V  S  K  E  G  G  V aaggtgtataccgttacgggctctggctgggaggtagtcaacacggagtcgaagcaggag
 K  V  Y  T  V  T  G  S  G  W  E  V  V  N  T  E  S  K  Q  E
```

-continued

```
gtcggcattaaagagagcgattgggatggaaagggcaagtttacattcccgaagttgagc
 V  G  I  K  E  S  D  W  D  G  K  G  K  F  T  F  P  K  L  S tttacgttgttgaggtggaaggcctag
 F  T  L  L  R  W  K  A  -

SEQ ID NO: 330
LENGTH: 508
TYPE: PRT
ORGANISM: M. phaseolina
MATFTKISENDTPSISLNPAHRISKINDNVYGGFTEHMGRCIYGGIYDPGNPLSDEHGFRKDVIEAFQELNCP

VVRYPGGNFVATYHWLDGVGPKAQRPPRPELAWLGLETNEFGTDEFLKWCEVVGTEPYFALNFGTGTLDEALG

WIEYCNSSQNTYYANLRRKNGREKPYNVKYWALGNEMWGPWQVGQMTKEDYAHKAYQWAKAIKLLDPSVELIL

CGQDGTSTWDTYVIKECIRWEPHALGGSQTASLIAMHSIHIYTAAQEHLPNATAPRSAERAIEITAGLIDLAR

AENKVPHTAPRPTICFDEWNVWDPVRAPGELGAEEKYTLSDALAVAVWLNVFIRQSKHVGMANIAQSVNVISP

LMTNKDGLVKQTTWWPLLLFSKYMRGHTLAVNVRAAEYEGPTAPAWLRGTIETPYLDVSAAITDDGYVGLAVV

NVHESKAFETDLEGVVSKEGGVKVYTVTGSGWEVVNTESKQEVGIKESDWDGKGKFTFPKLSFTLLRWKA*

SEQ ID NO: 331
LENGTH: 2628 (including 150 bp 5' UTR and 150 bp 3' UTR)
TYPE: DNA
ORGANISM: M. phaseolina
AATGACTGCCGTGCTTCTTCCCCGCGCTTTTCGTAGTGCAAATTTCCGCTACAGCATGCACTCTGCTATATAG

ACTGCGGAGGTTCCCCTCTGTTGTGCCGCGCGCTGCCGTCTTCTCACCGCCGCGCTGTTGCTGTCTCGTCCGT

CACAATGCTGAGCTCCGTTTCAGCTGGCCTCTTTGGCCTTGCCATTCTTTTGCCTTCAACCTATGCTCGGATT

CCTCGTCAAGGACGCCAGCTCTCGGCTGCTCCGTTCATCAATGCCACGGCAGCCAATGTCAGCAGCGTAGCTT

TGGAGATCAACACCAAGGACACGTCGCTGCGCAACAAGACAGCCCCGTATCTGTATGGTTTGATGCATGAAGA

TATCAACCATTCCGGAGACGGTGGCATTTATGCTGAGCTCCTGACGAACAGAGCCTTTCAAGGCTAGTGACAG

GTACATTGAGTAGTTGGATAAGTCGTTAACTGCGTGCAGGCTCAAACATCATCCCGGGCGCCGTCGATGGCCT

TACTGGCAATCTCATCATTGACAGCGAAAACCCTGTTGTTCCCTATGGACCCGTCCTGACGGGCTGGGCCCCC

ATTGGGAATGTGCGGTTGACACTGGACGTTCTCCATCCTCTCTCCGAGGCCCTGCATACTTCTCTGCAGATTG

ATGTCCCAGCAAACGCGACTGGCGAAGTCGGAGTCCAAAACTTTGGTTGGTGGGGAATGGACGTTTCTCCCCA

GACCTACAACGCTTCGTTTTACGTCTCTGCCAACCAGCCACGCTATCTCAGTAACCAGACAACCTTCACAGTC

TCGCTGCGTTCGAACCTCACCGGTGAGGTTTGGGTCTCGGAGCAGATTGGCCCTGTGGACGTACCTGTTCTTG

GCTACACTCAACTGAATGCTTCTATTGTCAATACGGTCACGGCTCCGAACTCGAATAATACGTTTGCCCTTAC

CATGGACGCTTCTGAAGTCGCCGGACAGACCCTCTACTTCTCTCTGTTCTCGCTCTTCCCCGAGACATTCAAG

GATAGGCCGAATGGTCTGCGGAAGGACATTGCGCAGGCTTTCTACGATATGAAGCCGCGCTTCTTGCGTTTCC

CTGGTGGCAATAATCTTGAAGGGGTCTCTGTAGACAAACGTTGGAAGTGGTGGAAGACCATTGGCCCGCTCAA

GGACCGCCCTGGCCGGCCCGGCAACTGGAACTATTACAACACTGATGGACTGGGTCTCCTCGAATATCTCGAG

TGGTGCGAAGACATGGAGATCGAGCCCGTCCTCGCCGTGTACGCCGGTTTCTCGCTCGACATCTGGGGCCAGT

CGGGCACAGACTGGCCGCAGGATCGCATGGGCGAGGTTTTGCAAGAGGCTCTGGACGAGCTCGAGTATGTCAC

TGGCGACACATCGACCAAATGGGGAGCTCTGCGTGCCGATCATGGCCATCCGGAGCCGTTCGCCATCAACTTC

ATCGAAATCGGCAATGAGGATTGGTTCTCTGGCACGTATCCACGCCGTTGGGCTTACCTCTACGAGGGCTTGA

AAGCCAAATACCCTAACGTTACCTACATCTCTTCCGCGTACAATGAAAACACGGAGTACACGATCGATATCCC

GGCTGGTGCTTACTGGGATACACACCACTATGAGGTAACCGCTCGATCTCGCATTTCCTCGAACTGATTGTAC

TGATTTTGATGATCAGGAACCGAGCTACTTTCTCGAGAACTTCGACTTCTATGACAATTGGCAAACCTCTACC

GACAACGAGGGTGTCGGCGTGCTTCTTGGCGAGTACAGCGTCTACCAGGTCGACACGCCCGACGGTGTCGTCA

ACTTCTCGAATCCAACTGACATCCATGTGTACTATCCGCGCATGATCTCCGCCATTGCCGAAGGCATCTACGC

GCTTGGCGCTGAGCGCAACCCGAACACCGTCAAGCTCAATTCGTACGCGCCCAGCCTGCAGAACAGAAATTGG
```

-continued

```
TACaACTGGACTCCCGATATGATCAGCTACGAGGCCGATCCCAGCAAGACCGTGCTCAGCACCAGCTACTGGC

AGCAGCACCTGTTCGCGCATTACCGTGGCACCCAGAGCGCTGCCGGTCACCAACACGCTGGGTGACTTCAACCC

GCTCTACTGGCAGAGTAGCATTGAAGAGGAGACGGGTTCTATCTACCTCAAGGCTAGTTTGAGAATTTTTGTA

CTTCTTTCATTGAACAGCAAATTTCTGACGAGTGAAGTACAGGTCATCAACGCCGGCAACACCACAATTCCTC

TCAGCGTCAGCATAGACGCAGCCTACAGCAAGGTCAACGGCACTATTATGCAGAATGATGACATCAACGGCTT

CAACTATGTCAACAATCAGACCGCCATCGTTCCGTTCCCGCTCGGTGACAAAGGAACCGCTTTTCCCGCCAAG

TCCTCCAACGGCAGCTTCATCTGGAATGTGCCGATCCACTCTATCACCGTTTTGCAGTTTGATTTGTAGGAAC

ATGTAAAAAATGATGGATGCATAGCAAGACGGCGTGATTGCCAAAGTAGATGAATATTAATATTTGACTGTTC

CAAGGACTCTGGCCAATCCGTCGGATTCTCAAATACAGCTGACTATGTGAGCATTGCTTATGTTTGCTAAGTA
```

SEQ ID NO: 332
LENGTH: 2145
TYPE: DNA
ORGANISM: M. phaseolina
FEATURE NAME/KEY: CDS
LOCATION: (1)...(2145)

```
atgctgagctccgtttcagctggcctcttt ggccttgccattcttttgccttcaacctat
 M   L   S   S   V   S   A   G   L   F   G   L   A   I   L   L   P   S   T   Y gctcggattcctcgtcaaggacgccagctctcggctgctccgttcatcaatgccacggca
 A   R   I   P   R   Q   G   R   Q   L   S   A   A   P   F   I   N   A   T   A gccaatgtcagcagcgtagctttggagatcaacaccaaggacacgtcgctgcgcaacaag
 A   N   V   S   S   V   A   L   E   I   N   T   K   D   T   S   L   R   N   K acagccccgtatctgtatggctcaaacatcatcccgggcgccgtcgatggccttactggc
 T   A   P   Y   L   Y   G   S   N   I   I   P   G   A   V   D   G   L   T   G aatctcatcattgacagcgaaaaccctgttgttccctatggacccgtcctgacgggctgg
 N   L   I   I   D   S   E   N   P   V   V   P   Y   G   P   V   L   T   G   W gcccccattgggaatgtgcggttgacactggacgttctccatcctctctccgaggccctg
 A   P   I   G   N   V   R   L   T   L   D   V   L   H   P   L   S   E   A   L catacttctctgcagattgatgtcccagcaaacgcgactggcgaagtcggagtccaaaac
 H   T   S   L   Q   I   D   V   P   A   N   A   T   G   E   V   G   V   Q   N tttggttggtggggaatggacgtttctccccagacctacaacgcttcgttttacgtctct
 F   G   W   W   G   M   D   V   S   P   Q   T   Y   N   A   S   F   Y   V   S gccaaccagccacgctatctcagtaaccagacaaccttcacagtctcgctgcgttcgaac
 A   N   Q   P   R   Y   L   S   N   Q   T   T   F   T   V   S   L   R   S   N ctcaccggtgaggtttgggtctcggagcagattggccctgtggacgtacctgttcttggc
 L   T   G   E   V   W   V   S   E   Q   I   G   P   V   D   V   P   V   L   G tacactcaactgaatgcttctattgtcaatacggtcacggctccgaactcgaataatacg
 Y   T   Q   L   N   A   S   I   V   N   T   V   T   A   P   N   S   N   N   T tttgcccttaccatggacgcttctgaagtcgccggacagaccctctacttctctctgttc
 F   A   L   T   M   D   A   S   E   V   A   G   Q   T   L   Y   F   S   L   F tcgctcttccccgagacattcaaggataggccgaatggtctgcggaaggacattgcgcag
 S   L   F   P   E   T   F   K   D   R   P   N   G   L   R   K   D   I   A   Q gctttctacgatatgaagccgcgcttcttgcgtttccctggtggcaataatcttgaaggg
 A   F   Y   D   M   K   P   R   F   L   R   F   P   G   G   N   N   L   E   G gtctctgtagacaaacgttggaagtggtggaagaccattggcccgctcaaggaccgccct
 V   S   V   D   K   R   W   K   W   W   K   T   I   G   P   L   K   D   R   P ggccggcccggcaactggaactattacaacactgatggactgggtctcctcgaatatctc
 G   R   P   G   N   W   N   Y   Y   N   T   D   G   L   G   L   L   E   Y   L gagtggtgcgaagacatggagatcgagcccgtcctcgccgtgtacgccggtttctcgctc
 E   W   C   E   D   M   E   I   E   P   V   L   A   V   Y   A   G   F   S   L gacatctggggccagtcgggcacagactggccgcaggatcgcatgggcgaggttttgcaa
 D   I   W   G   Q   S   G   T   D   W   P   Q   D   R   M   G   E   V   L   Q gaggctctggacgagctcgagtatgtcactggcgacacatcgaccaaatggggagctctg
 E   A   L   D   E   L   E   Y   V   T   G   D   T   S   T   K   W   G   A   L
```

```
cgtgccgatcatggccatccggagccgttcgccatcaacttcatcgaaatcggcaatgag
 R   A   D   H   G   H   P   E   P   F   A   I   N   F   I   E   I   G   N   E gattggttctctggcacgtatccacgccgttgggcttacctctacgagggcttgaaagcc
 D   W   F   S   G   T   Y   P   R   R   W   A   Y   L   Y   E   G   L   K   A aaataccctaacgttacctacatctcttccgcgtacaatgaaaacacggagtacacgatc
 K   Y   P   N   V   T   Y   I   S   S   A   Y   N   E   N   T   E   Y   T   I gatatcccggctggtgcttactgggatacacaccactatgaggaaccgagctactttctc
 D   I   P   A   G   A   Y   W   D   T   H   H   Y   E   E   P   S   Y   F   L gagaacttcgacttctatgacaattggcaaacctctaccgacaacgagggtgtcggcgtg
 E   N   F   D   F   Y   D   N   W   Q   T   S   T   D   N   E   G   V   G   V cttcttggcgagtacagcgtctaccaggtcgacacgcccgacggtgtcgtcaacttctcg
 L   L   G   E   Y   S   V   Y   Q   V   D   T   P   D   G   V   V   N   F   S aatccaactgacatccatgtgtactatccgcgcatgatctccgccattgccgaaggcatc
 N   P   T   D   I   H   V   Y   Y   P   R   M   I   S   A   I   A   E   G   I tacgcgcttggcgctgagcgcaacccgaacaccgtcaagctcaattcgtacgcgcccagc
 Y   A   L   G   A   E   R   N   P   N   T   V   K   L   N   S   Y   A   P   S ctgcagaacagaaattggtacaactggactcccgatatgatcagctacgaggccgatccc
 L   Q   N   R   N   W   Y   N   W   T   P   D   M   I   S   Y   E   A   D   P agcaagaccgtgctcagcaccagctactggcagcagcacctgttcgcgcattaccgtggc
 S   K   T   V   L   S   T   S   Y   W   Q   Q   H   L   F   A   H   Y   R   G acccagacgctgccggtcaccaacacgctgggtgacttcaacccgctctactggcagagt
 T   Q   T   L   P   V   T   N   T   L   G   D   F   N   P   L   Y   W   Q   S agcattgaagaggagacgggttctatctacctcaaggctagtttgagaattttgtactt
 S   I   E   E   E   T   G   S   I   Y   L   K   A   S   L   R   I   F   V   L ctttcattgaacagcaaatttctgacgagtgaagtacaggtcatcaacgccggcaacacc
 L   S   L   N   S   K   F   L   T   S   E   V   Q   V   I   N   A   G   N   T acaattcctctcagcgtcagcatagacgcagcctacagcaaggtcaacggcactattatg
 T   I   P   L   S   V   S   I   D   A   A   Y   S   K   V   N   G   T   I   M cagaatgatgacatcaacggcttcaactatgtcaacaatcagaccgccatcgttccgttc
 Q   N   D   D   I   N   G   F   N   Y   V   N   N   Q   T   A   I   V   P   F ccgctcggtgacaaaggaaccgcttttcccgccaagtcctccaacggcagcttcatctgg
 P   L   G   D   K   G   T   A   F   P   A   K   S   S   N   G   S   F   I   W aatgtgccgatccactctatcaccgttttgcagtttgatttgtag
 N   V   P   I   H   S   I   T   V   L   Q   F   D   L   -

SEQ ID NO: 333
LENGTH: 714
TYPE: PRT
ORGANISM: M. phaseolina
MLSSVSAGLFGLAILLPSTYARIPRQGRQLSAAPFINATAANVSSVALEINTKDTSLRNKTAPYLYGSNIIPG

AVDGLTGNLIIDSENPVVPYGPVLTGWAPIGNVRLTLDVLHPLSEALHTSLQIDVPANATGEVGVQNFGWWGM

DVSPQTYNASFYVSANQPRYLSNQTTFTVSLRSNLTGEVWVSEQIGPVDVPVLGYTQLNASIVNTVTAPNSNN

TFALTMDASEVAGQTLYFSLFSLFPETFKDRPNGLRKDIAQAFYDMKPRFLRFPGGNNLEGVSVDKRWKWWKT

IGPLKDRPGRPGNWNYYNTDGLGLLEYLEWCEDMEIEPVLAVYAGFSLDIWGQSGTDWPQDRMGEVLQEALDE

LEYVTGDTSTKWGALRADHGHPEPFAINFIEIGNEDWFSGTYPRRWAYLYEGLKAKYPNVTYISSAYNENTEY

TIDIPAGAYWDTHHYEEPSYFLENFDFYDNWQTSTDNEGVGVLLGEYSVYQVDTPDGVVNFSNPTDIHVYYPR

MISAIAEGIYALGAERNPNTVKLNSYAPSLQNRNWYNWTPDMISYEADPSKTVLSTSYWQQHLFAHYRGTQTL

PVTNTLGDFNPLYWQSSIEEETGSIYLKASLRIFVLLSLNSKFLTSEVQVINAGNTTIPLSVSIDAAYSKVNG

TIMQNDDINGFNYVNNQTAIVPFPLGDKGTAFPAKSSNGSFIWNVPIHSITVLQFDL*
```

-continued

SEQ ID NO: 334
LENGTH: 3344 (including 150 bp 5' UTR and 150 bp 3' UTR)
TYPE: DNA
ORGANISM: M. phaseolina

CGGCCGTCCGATCGCGCGCCCGACGCTGCTTTGCCCGACGCGGAGCTCTGGGCGCCCGCTATATGAAGGCAGA

ATGTCGCCAGCTGCGAGGAGCAGGCCCGGCCAGGAGACTGTCTTCGAGCGGGCGCAATGCTGTCGCCGCCCTC

CACGATGGCGCGGTTGCTGTCCTTGACGTCGGCGCTGCTGCCACTGCTTGCCCAGCTGCCCTCCGCCTCCGCG

CAGGAATGGCCAATCCACGACACCGGGCTCACCGATGCCGTCCAGTGGGACCACTACAGCTTCATCGTCGAGG

GCAAGCGCGTCTATCTCTTCGGCGGTGAAATGCACCCCTTCCGCCTCCCCGTGCCGGAACTGTGGCAGGACAT

TGTCCAGAAGACCAAGGCGCTGGGCTTCAACACCTTCTCCTTCTACACCAATTGGTTCTTCCACAACCCGCAT

CCCAACGAGACCGACTTCGAGACCGCGGCACACGACATCGGCCGTCTCCTCGCCTATGCCAACGAGGCCGGCC

TGTTCGTGGCGGTGCGCCCCGGTCCGTACGTCAACGCCGAGCTCAACGCCGGCGGATTCCCGCTGTGGGTCAC

GACGGGCGCGTACGGCGAGCTGCGCGACGACAACTCGTCCTACGCCGGCGCCTGGACTCCCTACCAGGACCGC

ATTGCCCAGATTGTCGCCCCCTACCAGATCCACAAGAACGGCACCGTCATCAGCTACCAGCTGGAGAACGAAT

ACGGCGAGCAATGGCTCAATTCGAGGACGAAGACGCCCAACCCGCCCGCCGTCAACTACATGGTCCAACTGCA

CGAGAACGCGCGCAGGAACGGCATTGACGTTCCGACCACCCACAACAGCCCCAATCTGAACGATTTCTCGTGG

TCCAAGGACCAGGACACCGTGGGCGCCGGTGGAAATGTGGATGTCTTGGGACTGGACAACTACGTGGGTGGCC

TTCCCGTGTGACGAGATGATGATCCGCTGACCCCCTGCAGCCTCTTTGCTGGTCCTGCGACCAATCCGAATGC

ACCGGTGTGTCCAACGACTACAAGCTCGTCGAGTACTACAGCTGGTTCCAGAGGAATACTCCGAGCGTGCCAT

CCATGATGCCCGAGTTCCAGGGTGGCCGCTACAACCCGCTGGACGGAGATGCGGGCCAATGCCTTGAGCCAAT

GGGTCCTGAGTTCCGTAACCTCTTCTACCGCCACAACATCGATCAGAAGGTCACCGCCATGGTCCTTTACACC

CTCTTCGGCGGAACAAACTGGGGGTGGATGGCCGCTCCCTTCATTGGCACGAGCTACGATTACGCCGCCCCGA

TTGCCGAGGATCGGTCGCTCAGAGACAGCTGGTACGAGACGAAGAGTCTGGCGCTTTTCACGAGGGTCGCCGA

GGACCTCCGCGAGGCGGACCGGGTGGGCAACAGCACCTCGTACAGCACGAACTCGGCCGTGCTCGCCACCGAG

CTCCGCAACGCCGAGACTGGAGGCGCTTTCTACATTGCCAGACATGCCAACTCAGTGACCGGCGAGCCTGTCG

CGTTCCACCTGCGCGTGAAGACGTCCATTGGAAACTTGACCATTCCGCAGAGGGAGGGACAAATCGAGCTCAA

CGCTCGTGAGGCCAAGATCGTGCCGACTGATTTCCGCTTTTCCGGACAGAGGCTCATTTACTCCACTGCCGAG

GTTTTCACGTATGTTGAGCTGGACGGCAAGCCGACTGTCGCACTCTGGGTCCCGGACGGCGAGAGCGGCGAGT

TCTTCCTTGAAGGCAAAGGCAACGTCTCCGCAACGGCCTCTCCCAGCGATGGCGTCACATTCCACCAGGATGC

ACGCGGATTGATTGTCAACTTTGCAAACCAGACCGGCACCACCGTCATTGATACCGATGCTGCGCGTTTCGTT

CTCCTCGACCGCACTGACGCGTGGAAGACGTTCGCTCCAGTGCTCACCACTGACCCTCACGCCCCTGTCGACC

AGACCGTCCTGGTCCAAGGCCCGCATCTCGTCCGGACCGCCACTGTCGAGGATGACACTCTCAAGCTGACAGG

CGATACCAGCGAGGAAACGACTCTTCAGATCTTCGCCTCCGCCTCCATCAAGGCCGTCACCTGGAACGGCGAA

GCCCTCTCCACAACCTCCACCCCCTACGGAAGCCTCACAGCCACCCTCTCCGGCCCCGCCGAAGTCACCCTCC

CCTCCCTCTCCGCCCTCTCCTGGAAGACAGCCCCCAGCCTGCCCGAAATCGCGCCCAACTACACGCTCTCGCC

CGCAGTCTGGAAGCCCGCCAACGCTAGCACCACGCCCTCGCAATTCACCGCCGCCACGACGCCCTACCTCTAC

ATCGACGCGCTCGGCTTCCACGTCGGCAACCACATCTACCGCGCGACCTTCACCGGCCCCGCCTCCGGCGTCT

ACCTCGCGCTGCAGGGCGGCACCGGCTTCGGGTGGAGCGCCTACCTGAACGGGCGCTTCGTCCACGCCGAGCC

CGGCTCCTCGGAGCTCGAGGCGACCAACGCGACGATCGCTTTCACCAACGCCACCGACGGAGAAAACGTGCTC

GTCATCCTCATGGACAACAGTGGCCACGAGCAGCGCGCCGAGGCGCTCGAGATCCGCGGCATCACCAACGCCA

CGCTCCTCGGCAACGGCGCCGGCTTCGACGCCTGGCACGTCGCCGGCACGGCCGGCGAGGCCGCCTCCACGAC

GCTCGACCCCGTGCGCGGCGTGTACAACGAGGGCGGCTGGCGGGCGAGCGCCTGGGCTGGCACCTGCCGGGC

TTCGACGACTCGGCGTGGGCCGCCGGCTCCCCGAGCGAGGGCTTCTCTGGCGCGGCGGTGCGCTTCTACCGCG

```
CGCGCGTCGCGCTGGATGTGCCGGCCGGGCACGACGCCGCGGTGCACTTCACCATGAAGGCGCTGGGCAGCCA

GGCGGTGCGCGCGCTGCTGTACGTGAACGGCTATCAGTTTGGCCGCTTCCGGCCGGCGGTGAGCACGGCGACG

GACTTTCCCGTGCCGCCGGGCGTGCTGGATTACGCGGGCGAGAATGAGATCGTGGTGGCGGTGTGGGCGCAGA

GCGAGGAGGGGCGCAGGTGGAGGTGGGGTGGGAGGTGCAGGGCGTTGTGAGGAGTGGGTTGGATGTGAGATT

TGATGGGCATATTTGAGGCCTGGCTGGAGCGAGGAGAGGTTGGCGTATGCTTAGAGGGGAAGGAGGTGAAGT

TACCGATCCCGTCCGAAGGGAGGATTTGTGCAAATTCCGCTGGTCTGTTATGGGTGCTTGCCGTCTGTTCCCC

TTCTTTTTGCTGGCACCGGCATTGAGAGCTTACTTCTGCAGGGTTCGGGGCAGATGG
```

```
SEQ ID NO: 335
LENGTH: 2994
TYPE: DNA
ORGANISM: M. phaseolina
FEATURE NAME/KEY: CDS
LOCATION: (1)...(2994)
atggcgcggttgctgtccttgacgtcggcgctgctgccactgcttgcccagctgccctcc
  M   A   R   L   L   S   L   T   S   A   L   L   P   L   L   A   Q   L   P   S gcctccgcgcaggaatggccaatccacgacaccgggctcaccgatgccgtccagtgggac
  A   S   A   Q   E   W   P   I   H   D   T   G   L   T   D   A   V   Q   W   D cactacagcttcatcgtcgagggcaagcgcgtctatctcttcggcggtgaaatgcacccc
  H   Y   S   F   I   V   E   G   K   R   V   Y   L   F   G   G   E   M   H   P ttccgcctccccgtgccggaactgtggcaggacattgtccagaagaccaaggcgctgggc
  F   R   L   P   V   P   E   L   W   Q   D   I   V   Q   K   T   K   A   L   G ttcaacaccttctccttctacaccaattggttcttccacaacccgcatcccaacgagacc
  F   N   T   F   S   F   Y   T   N   W   F   F   H   N   P   H   P   N   E   T gacttcgagaccgcggcacacgacatcggccgtctcctcgcctatgccaacgaggccggc
  D   F   E   T   A   A   H   D   I   G   R   L   L   A   Y   A   N   E   A   G ctgttcgtggcggtgcgccccggtccgtacgtcaacgccgagctcaacgccggcggattc
  L   F   V   A   V   R   P   G   P   Y   V   N   A   E   L   N   A   G   G   F ccgctgtgggtcacgacgggcgcgtacggcgagctgcgcgacgacaactcgtcctacgcc
  P   L   W   V   T   T   G   A   Y   G   E   L   R   D   D   N   S   S   Y   A ggcgcctggactccctaccaggaccgcattgcccagattgtcgcccctaccagatccac
  G   A   W   T   P   Y   Q   D   R   I   A   Q   I   V   A   P   Y   Q   I   H aagaacggcaccgtcatcagctaccagctggagaacgaatacggcgagcaatggctcaat
  K   N   G   T   V   I   S   Y   Q   L   E   N   E   Y   G   E   Q   W   L   N tcgaggacgaagacgcccaacccgcccgccgtcaactacatggtccaactgcacgagaac
  S   R   T   K   T   P   N   P   P   A   V   N   Y   M   V   Q   L   H   E   N gcgcgcaggaacggcattgacgttccgaccacccacaacagccccaatctgaacgatttc
  A   R   R   N   G   I   D   V   P   T   T   H   N   S   P   N   L   N   D   F tcgtggtccaaggaccaggacaccgtgggcgccggtggaaatgtggatgtcttgggactg
  S   W   S   K   D   Q   D   T   V   G   A   G   G   N   V   D   V   L   G   L gacaactaccctctttgctggtcctgcgaccaatccgaatgcaccggtgtgtccaacgac
  D   N   Y   P   L   C   W   S   C   D   Q   S   E   C   T   G   V   S   N   D tacaagctcgtcgagtactacagctggttccagaggaatactccgagcgtgccatccatg
  Y   K   L   V   E   Y   Y   S   W   F   Q   R   N   T   P   S   V   P   S   M atgcccgagttccagggtggccgctacaacccgctggacggagatgcgggccaatgcctt
  M   P   E   F   Q   G   G   R   Y   N   P   L   D   G   D   A   G   Q   C   L gagccaatgggtcctgagttccgtaacctcttctaccgccacaacatcgatcagaaggtc
  E   P   M   G   P   E   F   R   N   L   F   Y   R   H   N   I   D   Q   K   V accgccatggtcctttacaccctcttcggcggaacaaactgggggtggatggccgctccc
  T   A   M   V   L   Y   T   L   F   G   G   T   N   W   G   W   M   A   A   P ttcattggcacgagctacgattacgccgccccgattgccgaggatcggtcgctcagagac
  F   I   G   T   S   Y   D   Y   A   A   P   I   A   E   D   R   S   L   R   D agctggtacgagacgaagagtctggcgcttttcacgagggtcgccgaggacctccgcgag
  S   W   Y   E   T   K   S   L   A   L   F   T   R   V   A   E   D   L   R   E
```

```
gcggaccgggtgggcaacagcacctcgtacagcgaactcggccgtgctcgccaccgag
 A  D  R  V  G  N  S  T  S  Y  S  T  N  S  A  V  L  A  T  E ctccgcaacgccgagactggaggcgctttctacattgccagacatgccaactcagtgacc
 L  R  N  A  E  T  G  G  A  F  Y  I  A  R  H  A  N  S  V  T ggcgagcctgtcgcgttccacctgcgcgtgaagacgtccattggaaacttgaccattccg
 G  E  P  V  A  F  H  L  R  V  K  T  S  I  G  N  L  T  I  P cagagggagggacaaatcgagctcaacgctcgtgaggccaagatcgtgccgactgatttc
 Q  R  E  G  Q  I  E  L  N  A  R  E  A  K  I  V  P  T  D  F cgcttttccggacagaggctcatttactccactgccgaggttttcacgtatgttgagctg
 R  F  S  G  Q  R  L  I  Y  S  T  A  E  V  F  T  Y  V  E  L gacggcaagccgactgtcgcactctgggtcccggacggcgagagcggcgagttcttcctt
 D  G  K  P  T  V  A  L  W  V  P  D  G  E  S  G  E  F  F  L gaaggcaaaggcaacgtctccgcaacggcctctcccagcgatggcgtcacattccaccag
 E  G  K  G  N  V  S  A  T  A  S  P  S  D  G  V  T  F  H  Q gatgcacgcggattgattgtcaactttgcaaaccagaccggcaccaccgtcattgatacc
 D  A  R  G  L  I  V  N  F  A  N  Q  T  G  T  T  V  I  D  T gatgctgcgcgtttcgttctcctcgaccgcactgacgcgtggaagacgttcgctccagtg
 D  A  A  R  F  V  L  L  D  R  T  D  A  W  K  T  F  A  P  V ctcaccactgaccctcacgcccctgtcgaccagaccgtcctggtccaaggcccgcatctc
 L  T  T  D  P  H  A  P  V  D  Q  T  V  L  V  Q  G  P  H  L gtccggaccgccactgtcgaggatgacactctcaagctgacaggcgataccagcgaggaa
 V  R  T  A  T  V  E  D  D  T  L  K  L  T  G  D  T  S  E  E acgactcttcagatcttcgcctccgcctccatcaaggccgtcacctggaacggcgaagcc
 T  T  L  Q  I  F  A  S  A  S  I  K  A  V  T  W  N  G  E  A ctctccacaacctccaccccctacggaagcctcacagccaccctctccggccccgccgaa
 L  S  T  T  S  T  P  Y  G  S  L  T  A  T  L  S  G  P  A  E gtcaccctcccctccctctccgccctctcctggaagacagccccagcctgcccgaaatc
 V  T  L  P  S  L  S  A  L  S  W  K  T  A  P  S  L  P  E  I gcgcccaactacacgctctcgcccgcagtctggaagcccgccaacgctagcaccacgccc
 A  P  N  Y  T  L  S  P  A  V  W  K  P  A  N  A  S  T  T  P tcgcaattcaccgccgccacgacgcccacctctacatcgacgcgctcggcttccacgtc
 S  Q  F  T  A  A  T  T  P  Y  L  Y  I  D  A  L  G  F  H  V ggcaaccacatctaccgcgcgaccttcaccggcccccgcctccggcgtctacctcgcgctg
 G  N  H  I  Y  R  A  T  F  T  G  P  A  S  G  V  Y  L  A  L cagggcggcaccggcttcgggtggagcgcctacctgaacgggcgcttcgtccacgccgag
 Q  G  G  T  G  F  G  W  S  A  Y  L  N  G  R  F  V  H  A  E cccggctcctcggagctcgaggcgaccaacgcgacgatcgctttcaccaacgccaccgac
 P  G  S  S  E  L  E  A  T  N  A  T  I  A  F  T  N  A  T  D ggagaaaacgtgctcgtcatcctcatggacaacagtggccacgagcagcgcgccgaggcg
 G  E  N  V  L  V  I  L  M  D  N  S  G  H  E  Q  R  A  E  A ctcgagatccgcggcatcaccaacgccacgctcctcggcaacggcgccggcttcgacgcc
 L  E  I  R  G  I  T  N  A  T  L  L  G  N  A  G  F  D  A tggcacgtcgccggcacggccggcgaggccgcctccacgacgctcgaccccgtgcgcggc
 W  H  V  A  G  T  A  G  E  A  A  S  T  T  L  D  P  V  R  G gtgtacaacgagggcgggctggcgggcgagcgcctgggctggcacctgccgggcttcgac
 V  Y  N  E  G  G  L  A  G  E  R  L  G  W  H  L  P  G  F  D gactcggcgtgggccgccggctcccccgagcgagggcttctctggcgcggcggtgcgcttc
 D  S  A  W  A  A  G  S  P  S  E  G  F  S  G  A  A  V  R  F taccgcgcgcgcgtcgcgctggatgtgccggccgggcacgacgccgcggtgcacttcacc
 Y  R  A  R  V  A  L  D  V  P  A  G  H  D  A  A  V  H  F  T atgaaggcgctgggcagccaggcggtgcgcgcgctgctgtacgtgaacggctatcagttt
 M  K  A  L  G  S  Q  A  V  R  A  L  L  Y  V  N  G  Y  Q  F ggccgcttccggccggcggtgagcacggcgacggactttcccgtgccgccgggcgtgctg
 G  R  F  R  P  A  V  S  T  A  T  D  F  P  V  P  P  G  V  L
```

```
gattacgcgggcgagaatgagatcgtggtggcggtgtgggcgcagagcgaggaggggcg
 D   Y   A   G   E   N   E   I   V   V   A   V   W   A   Q   S   E   E   G   A caggtggaggtggggtgggaggtgcagggcgttgtgaggagtgggttggatgtgagattt
 Q   V   E   V   G   W   E   V   Q   G   V   V   R   S   G   L   D   V   R   F gatgggcatatttgaggcctggctggagcgaggagaggttggcgtatgcttag
 D   G   A   Y   L   R   P   G   W   S   E   E   R   L   A   Y   A   -
```

```
SEQ ID NO 45: 336
LENGTH: 997
TYPE: PRT
ORGANISM: M. phaseolina
MARLLSLTSALLPLLAQLPSASAQEWPIHDTGLTDAVQWDHYSFIVEGKRVYLFGGEMHPFRLPVPELWQDIV

QKTKALGFNTFSFYTNWFFHNPHPNETDFETAAHDIGRLLAYANEAGLFVAVRPGPYVNAELNAGGFPLWVTT

GAYGELRDDNSSYAGAWTPYQDRIAQIVAPYQIHKNGTVISYQLENEYGEQWLNSRTKTPNPPAVNYMVQLHE

NARRNGIDVPTTHNSPNLNDFSWSKDQDTVGAGGNVDVLGLDNYPLCWSCDQSECTGVSNDYKLVEYYSWFQR

NTPSVPSMMPEFQGGRYNPLDGDAGQCLEPMGPEFRNLFYRHNIDQKVTAMVLYTLFGGTNWGWMAAPFIGTS

YDYAAPIAEDRSLRDSWYETKSLALFTRVAEDLREADRVGNSTSYSTNSAVLATELRNAETGGAFYIARHANS

VTGEPVAFHLRVKTSIGNLTIPQREGQIELNAREAKIVPTDFRFSGQRLIYSTAEVFTYVELDGKPTVALWVP

DGESGEFFLEGKGNVSATASPSDGVTFHQDARGLIVNFANQTGTTVIDTDAARFVLLDRTDAWKTFAPVLTTD

PHAPVDQTVLVQGPHLVRTATVEDDTLKLTGDTSEETTLQIFASASIKAVTWNGEALSTTSTPYGSLTATLSG

PAEVTLPSLSALSWKTAPSLPEIAPNYTLSPAVWKPANASTTPSQFTAATTPYLYIDALGFHVGNHIYRATFT

GPASGVYLALQGGTGFGWSAYLNGRFVHAEPGSSELEATNATIAFTNATDGENVLVILMDNSGHEQRAEALEI

RGITNATLLGNGAGFDAWHVAGTAGEAASTTLDPVRGVYNEGGLAGERLGWHLPGFDDSAWAAGSPSEGFSGA

AVRFYRARVALDVPAGHDAAVHFTMKALGSQAVRALLYVNGYQFGRFRPAVSTATDFPVPPGVLDYAGENEIV

VAVWAQSEEGAQVEVGWEVQGVVRSGLDVRFDGAYLRPGWSEERLAYA*

SEQ ID NO: 337
LENGTH: 2603 (including 150 by 5' UTR and 150 by 3' UTR)
TYPE: DNA
ORGANISM: M. phaseolina
GAGGTCACAATGCCTGGTCACAATGCCATCCTTGCGCGCTCCCAGCACCGTCGAGCCTTCGTAGAGCCTGGCA

TATAAGTCTGCGTAGAGTGGCCGTCATTTCCAGACTCCGTGCTTCGGGAACAGCAGTTTCCTCGTCCCCATTC

CAAGATGCGTGTCTCTGCGGTCCTCGCCCTGCCGGTTCTGGCAGCCTATTCTGTTGCTGCTCAGCCGTTTCCC

AACACCACCAGCCCTCCTACCGGTGCAGCAACCCCCTACCAGCTCCAGGCTCCTCCGCTCGACACTCCTTGGA

CAGAGCAAGTGGGGACGAGCCCTTGGCCCGAATATCCACGTCCGCAACTGCGTCGTGAGCAATGGCAGAACCT

CAATGGCCTCTGGACGTATCAGGCAGCTCCATCCTTCGGGGAGACCCCCGGAGCCCTTCCTGCGCTTCCTTCC

ACTCCCCTGAGCCGCGAGATTCTCATCCCGTCCTGCATTGAGAGCGGCTTGTCCGGTATCCAAGAGCTCGACG

TCACCAACTTTTGGCTCGCAACAACTTTCACGGTTCCCAGCAACTGGAGCGGCCAGGCCATCCTGCTAAACTT

CGAGGCTGTGGACTACGAGGCTACTGTCTTCATCAACGGCCAAGAGGCTGCATTTCACCGCGGTGGCTATTGG

CGCTTCACTGTCGACGCCACGCAATACGTTAATTTCAACGGGACCAACGAATTGTGAGTGAAACACGCACGCC

GACAGCCTTGCTCGGAGCCGGGGTTACTGACATGGGTGCCCCAGGGTCGTTTACGTTTTCGATCCGACGGACT

CGCCCGGCTACGAGATCGCCAGGGGCAAGCAGACCCGAAACCCCAGCCACATCTTCTACAGGCCCTGCAGTGG

CATTTGGCAGACCGTGTGGTTGGAGCCCGCCCCGCGCGACCACATCACGCGATTGGACGTTGCGGCTGGCTCG

GACGGAGCAGGTAAGCCGGGAAAAACGACGACCCGCCGGGTAGCTCCCCTGCGACGGTCGAGAACCCGAGGAT

TGCTAACGCTGCTTCAAAAGTCAATGTCACCGTCTTCAGCTCCTCCAACCAATCCGTGCCCGTGGAGTTCTCT

ATTCTCCAGGATGGCAATGTTATTGCGACGCAGGAGGGCACCACTGGCGACCCCTTCGACCTCTCCGTCGACT

CCCCGCAACTGTGGTCGCCCGACTCGCCCAACTTGTACAACATCACGGTGCGTTTGGGAGACGATGTCGTCGA

GAGCTACACCGGATTCCGCACTATTTCCTCGGGCATCGTCGACGGCGTAAGGCGGCCTCTTCTGAACGGCGAG
```

-continued

```
TTCGTCTTCCAGTTCGGCACGCTCGACCAGGGCTACTGGCCCGACGGCCTGTACCTTGCTCCGAACCTCGAGG

CTCTCGTTTTCGACCTTCAGCTCCTGAAGAGCTTGGGAATGAACATGGTCCGCAAGCACGTAAGTTATGTTGC

ATGGTGCACATCTCAGGAGGAAGCTTGCTGACGGTGATTCCAAAAATAGATTAAGGTCGAGCCTGATCTCTTC

TACCATGCGTGCGATACCCTGGGCCTGCTCGTCATTCAAGACATGCCCAGCATGCTCGTGGATGGGGGCGAGC

CCAACGCAGAGCAGCAGGCCGAATGGGAGCGCCAGCTCGATATACTCATTACTGAGCACAAGAGCTACACCTG

CATTGTTACCTGGGTATGCACAAGCTCTTGTCCTCCGGAGCTTAAGCCAAAGCTAATTCCACCGTGCTTAGGT

AATCTACAACGAAGGCTGGGGCCAGATCCGGAGCAACTACTTCCCCGAGTTTGGCCTCGCCGACAGAATCAGG

GCGCAGGATCCCAGCAGGCTCATTGACGCCACCAGCGGCTGGCACGACCACGGTGCCGGTGATTTCTCTGTAA

GTTATCCCGGGTACCTTGAGGGGATCTGTGTTTAACCTGGTTCAGGATAACCATCACTACGCCACCCCTCAAT

GTGGAGCGCCCTTCTACTCAACTCCCTCGGCCCCTTACGACCCCAACCGCATCGGCATCCAGGGCGAGTTTGG

CGGTATTGGACACAATGTTTCCATTGAGAAGTAAGTCCCTCCTACCAAATTTATAGACATCCTTGATTAACGG

GCCGATCACAGCCTCTGGAACGTCCAGCAAGCTATTGATACCATCAACCAGACTTACGAAATCAGCGCCGACC

TGTCCGCGTACAACTACCGCGCACGCGTGTTGTTCAACGAACTGGAGGACCAAGTCCGCATGTTTGCGTGCAG

TGCCGCTGTCTGGACGCAGACGTCGGATGTTGAGGGCGAGGTCAACGGCCTCGTTACCTACGACCGTCGCATC

GAGCGCGTCGACAGGAATCAGTGGCAATCCGACATCCAGGCTCTTTACGACGCCGCCGCGGGCCGTGGTGGCG

CTGGCGGCAACTCGTCCCGGGTGGCGATGCCGCAATATGTCTGATGAGTTTTCGGCTTCtTTTTTTTTTTCT

CTTCTTTCGTCGCGGGCTGAGCCAGAGCGTCGGCTGCCGAGGTGCAGAACCACTCCTGGCCCACCGCTATTTT

TCTCGTCCAGTTCGAGACTACTCGTCCTTCCACGGCTCTAATAATCCG
```

SEQ ID NO: 338
LENGTH: 1932
TYPE: DNA
ORGANISM: M. phaseolina
FEATURE NAME/KEY: CDS
LOCATION: (1)...(1932)

```
atgcgtgtctctgcggtcctcgccctgccggttctggcagcctattctgttgctgctcag
 M   R   V   S   A   V   L   A   L   P   V   L   A   A   Y   S   V   A   A   Q ccgtttcccaacaccaccagcccctcctaccggtgcagcaacccctaccagctccaggct
 P   F   P   N   T   T   S   P   P   T   G   A   A   T   P   Y   Q   L   Q   A cctccgctcgacactccttggacagagcaagtggggacgagcccttggcccgaatatcca
 P   P   L   D   T   P   W   T   E   Q   V   G   T   S   P   W   P   E   Y   P cgtccgcaactgcgtcgtgagcaatggcagaacctcaatggcctctggacgtatcaggca
 R   P   Q   L   R   R   E   Q   W   Q   N   L   N   G   L   W   T   Y   Q   A gctccatccttcggggagaccccggagcccttcctgcgcttccttccactcccctgagc
 A   P   S   F   G   E   T   P   G   A   L   P   A   L   P   S   T   P   L   S cgcgagattctcatcccgtcctgcattgagagcggcttgtccggtatccaagagctcgac
 R   E   I   L   I   P   S   C   I   E   S   G   L   S   G   I   Q   E   L   D gtcaccaacttttggctcgcaacaactttcacggttcccagcaactggagcggccaggcc
 V   T   N   F   W   L   A   I   T   F   T   V   P   S   N   W   S   G   Q   A atcctgctaaacttcgaggctgtggactacgaggctactgtcttcatcaacggccaagag
 I   L   L   N   F   E   A   V   D   Y   E   A   T   V   F   I   N   G   Q   E gctgcatttcaccgcggtggctattggcgcttcactgtcgacgccacgcaatacgttaat
 A   A   F   H   R   G   G   Y   W   R   F   T   V   D   A   T   Q   Y   V   N ttcaacgggaccaacgaattggtcgtttacgttttcgatccgacggactcgcccggctac
 F   N   G   T   N   E   L   V   V   Y   V   F   D   P   T   D   S   P   G   Y gagatcgccaggggcaagcagacccgaaaccccagccacatcttctacaggccctgcagt
 E   I   A   R   G   K   Q   T   R   N   P   S   H   I   F   Y   R   P   C   S ggcatttggcagaccgtgtggttggagcccgccccgcgcgaccacatcacgcgattggac
 G   I   W   Q   T   V   W   L   E   P   A   P   R   D   H   I   T   R   L   D gttgcggctggctcggacggagcagtcaatgtcaccgtcttcagctcctccaaccaatcc
 V   A   A   G   S   D   G   A   V   N   V   T   V   F   S   S   S   N   Q   S
```

```
gtgcccgtggagttctctattctccaggatggcaatgttattgcgacgcaggagggcacc
 V  P  V  E  F  S  I  L  Q  D  G  N  V  I  A  T  Q  E  G  T actggcgacccttcgacctctccgtcgactccccgcaactgtggtcgcccgactcgccc
 T  G  D  P  F  D  L  S  W  P  D  S  P aacttgtacaacatcacggtgcgtttgggagacgatgtcgtcgagagctacaccggattc
 N  L  Y  N  I  T  V  R  L  G  D  D  V  V  E  S  Y  T  G  F cgcactatttcctcgggcatcgtcgacggcgtaaggcggcctcttctgaacggcgagttc
 R  T  I  S  S  G  I  V  D  G  V  R  R  P  L  L  N  G  E  F gtcttccagttcggcacgctcgaccagggctactggcccgacggcctgtaccttgctccg
 V  F  Q  F  G  T  L  D  Q  G  Y  W  P  D  G  L  Y  L  A  P aacctcgaggctctcgttttcgaccttcagctcctgaagagcttgggaatgaacatggtc
 L  E  A  A  L  V  F  D  L  Q  L  L  K  S  L  G  M  N  M  V cgcaagcacattaaggtcgagcctgatctcttctaccatgcgtgcgataccctgggcctg
 R  K  H  I  K  V  E  P  D  L  F  Y  H  A  C  D  T  L  G  L ctcgtcattcaagacatgcccagcatgctcgtggatgggggcgagcccaacgcagagcag
 L  V  I  Q  D  M  P  S  M  L  V  D  G  G  E  P  N  A  E  Q caggccgaatgggagcgccagctcgatatactcattactgagcacaagagctacacctgc
 Q  A  E  D  I  L  I  T  T  E  H  K  S  Y  T  C attgttacctgggtaatctacaacgaaggctggggccagatccggagcaactacttcccc
 I  V  T  W  V  I  Y  N  E  G  W  G  Q  I  R  S  N  Y  F  P gagtttggcctcgccgacagaatcagggcgcaggatcccagcaggctcattgacgccacc
 E  F  G  L  A  D  R  I  R  A  Q  D  P  R  I  D  S  T agcggctggcacgaccacggtgccggtgatttctctgataaccatcactacgccaccccct
 S  G  W  H  D  H  G  A  G  D  F  S  D  N  H  H  Y  A  T  P caatgtggagcgcccttctactcaactccctcggccccttacgaccccaaccgcatcggc
 Q  C  G  A  P  F  Y  S  T  P  S  A  P  Y  D  P  N  R  I  G atccagggcgagtttggcggtattggacacaatgtttccattgagaacctctggaacgtc
 I  Q  G  E  F  G  G  I  G  H  N  V  S  I  E  N  L  W  N  V cagcaagctattgataccatcaaccagacttacgaaatcagcgccgacctgtccgcgtac
 Q  Q  A  I  D  T  I  N  Q  T  Y  E  I  S  A  D  L  S  A  Y aactaccgcgcacgcgtgttgttcaacgaactggaggaccaagtccgcatgtttgcgtgc
 N  Y  R  A  R  V  L  F  N  E  L  E  D  Q  V  R  M  F  A  C agtgccgctgtctggacgcagacgtcggatgttgagggcgaggtcaacggcctcgttacc
 S  A  A  V  W  T  Q  T  S  D  V  E  G  E  V  N  G  L  V  T tacgaccgtcgcatcgagcgcgtcgacaggaatcagtggcaatccgacatccaggctctt
 Y  D  R  R  I  E  R  V  D  R  N  Q  W  Q  S  D  I  Q  A  L tacgacgccgccgcgggccgtggtggcgctggcggcaactcgtcccgggtggcgatgccg
 Y  D  A  A  A  G  R  S  S  S  R  V  A  M  P caatatgtctga
 Q  Y  V  -

SEQ ID NO: 339
LENGTH: 643
TYPE: PRT
ORGANISM: M. phaseolina
MRVSAVLALPVLAAYSVAAQPFPNTTSPPTGAATPYQLQAPPLDTPWTEQVGTSPWPEYPRPQLRREQWQNLN

GLWTYQAAPSFGETPGALPALPSTPLSREILIPSCIESGLSGIQELDVTNEWLATTFTVPSNWSGQAILLNFE

AVDYEATVFINGQEAAFHRGGYWRFTVDATQYVNENGTNELVVYVFDPTDSPGYEIARGKQTRNPSHIFYRPC

SGIWQTVWLEPAPRDHITRLDVAAGSDGAVNVTVFSSSNQSVPVEFSILQDGNVIATQEGTTGDPFDLSVDSP

QLWSPDSPNLYNITVRLGDDVESYTGFRTISSGIVDGVRRPLLNGEFVFQFGTLDQGYWPDGLYLAPNLEAL

VFDLQLLKSLGMNMVRKHIKVEPDLFYHACDTLGLLVIQDMPSMLVDGGEPNAEQQAEWERQLDILITEHKSY

TCIVTWVIYNEGWGQIRSNYFPEFGLADRIRAQDPSRLIDATSGWHDHGAGDFSDNHHYATPQCGAPFYSTPS

APYDPNRIGIQGEFGGIGHNVSIENLWNVQQAIDTINQTYEISADLSAYNYRARVLFNELEDQVRMFACSAAV

WTQTSDVEGEVNGLVTYDRRIERVDRNQWQSDIQALYDAAAGRGGAGGNSSRVAMPQYV*
```

-continued

SEQ ID NO: 340
LENGTH: 3754 (including 150 by 5' UTR and 150 by 3' UTR)
TYPE: DNA
ORGANISM: *M. phaseolina*

TACCCCGCTCCATGGACAGTGAGCCGATAAGTGCTCGGGCAACTTTGTCGCGGATTACCGACAACTCCGCAGC

GGTGAATAAAACTCCAGGTCGGATTTCCCGGGGCGTGACTGTGGTCAGGAGAGGTTCCGTGTCTCGCTTCATC

AGCCATGCCGTCTCAGGCCGAGTCCTTCTCTTCGCCTCCGGACTGGTGCAACCTGGACATCATCCACCGCAAC

ACCCTCGCGCCCCGAGCCGCCTTCTTCAACTATTCGTCTCCATCTGCCGCACTCTTGTATGATCCGCAGACAT

CGGAATACGTGAAGAGCCTGAACGGACAATGGAAGTTCAGCTACGCCGTCAATCCCTACCGTGCTCCAGACGG

GTTCGAGCAGCCAGCGTTTGATGCATCAGCGTGGCCCGAGATACCCGTTCCCTCGCACTGGCAGTTGGAAGGG

TATGGAAAGCCCCATTACACAAACCTGCCATACCCGTTCCCGGTGGACCCGCCACACGTTCCGCTGGATGAAA

ATCCGACCGGTAGCTATCTGCGGAAGTTCACGGTGCCGAACGGATTCCGCGACAAACAAGTGCGGCTCCGGTT

TGAAGGCGTGGATTCGGCATTCCATGTCTGGGTGAACGGCCGAGAGTTAGGCTACTCGCAAGGCGCCAGGAAT

CCATCTGAGTTTGACGTAACTCCGTTCGTAATTTTCTCCGGGGAAAACACGGTCGCCGTGAGAGTATACCAGT

GGTCCGACGGCTCATATCTCGAAGATCAAGGTGAGCATGTGGTTTCCATGGACTGAACTGAGCATCGCTGATG

TCCACAGACCAATGGTGGCTCAGCGGCATTTTTCGTGACGTCAACCTGATCGCGTTTCCGAAATCTCACATTC

AGGATTTCTTTGTCAAGACTCTGTTAGACGAGAACTACGAGAACGCAGTCCTCCGGGTAGACCTCACGATAGA

GGGAGGCGGAGCGGTGACCCTCCAGCTTCTTCAGAATGACAAGTCCACCAAGGTCCTGGAGTCCTCGGGCGCG

CCTTCTGGAGATGGTACCCTCACGTTGGAATTACCGCTTGAGAACCCTCGCAAATGGACGGCGGAAGATCCTT

ACCTCTATCACCTTGTTATCCAGCTCGGCGATCAGACAATTGCGCATAGGGTTGGATTTCGCAGGGCAGAAAT

CAAGAATGGAATTTTCTTGGTCAACGGCGCGAGGATTGTGTTCCGGGGAGTCAACCGGCATGAACATCACCCA

ACGAAAGGAAGGGCGGTCGGCCCCGAGCTGTTACGGCATGACCTCCTTCTCATGAAGAAACACAACATCAACG

CCATCCGGACGTCCCACCAACCAAATGATACCCGTCTCTATGAGCTAGCGGATGAGCTGGGGTTCTGGATAAT

GGACGGTAAGCAGATCTTTTTAAGGAGTAAAAAGTGAAGTACGCATCTGTTTGATCAGTATTCACCCAGCGGA

TCCAAGGCAGGGTACTCTCAGTGACCGTGGGGATTTGAGTCAGTTGGAATTGTCCCTTAGGCCTTTTAGCATT

CATGTCCGGGCGACTTCTTCAGCTCTCCACTGACTACAGAGATCATCTGTTCTCCGCACATTTGAGTGTGGTG

TCGGGCTTTTACTCCGCTCGAATGCTTCCAGACCCGTATACTAACAGTAGAGCAGAAGCGGACCTCGAGACCC

ACGGCTTTGCATGCGTAGAAGAGGCAGCGCTATCACCAGAGGACAAGAAGAAGCCGTACGAGGAGAGAAAGTT

GATCACCTACGAAGCGGCTGCCCGCTGGACTTCCGACAATCCGGTATGGGAAAAGGCTTACGTGGACCGCATG

CAGCAAATGGTGGCGCGAGACAAGAATCATCCGTCGATTGTCATGTGGAGCCTGGGCAATGAGGCCTTCTACG

GATGCAATCACCAGGCGATGTACGACTGGGGGAAGAGGTACGACCCGGACAGGGTTATCCATTACGAAGGCGA

CATCCACGCTAAAACCGTCGACTTGTTCTCATTGATGTATCCGGAGCTGGACACGCTCCGGGATTTTGCAGAG

AAATGGGACGGCGCGAAGCCGCTGGTCCTTTGCGAATTTGCGCATGCCATGGGCAACGGGCCTGGTGCTTTGA

AAGAGTACGTCGAGCTGTTCTACAAGCATCGGTGCTTGCAGGGTGGCTGGGTGTGGGAATGGGCAAATCATGG

CCTTGAACATACTAGTCCGGACAGAAAGAAGTACTACGCCTATGGCGGTGATTTTGGAGACGAACCAAATGAC

GGGACGTTCGTGATGGATGGCCTGGTACGCTCAGACCCACAGCATTGGGCCAGGTCTGGTAGAATACAAGAAAG

CAATCGAGCCAGTCCAGCTCGTCTCAGGGAGCATTGAAGATGGCTACGTGGCTGTCGTCAATCGGTACGACTT

CTCCACCTTGGACCACCTGGAATGCCACCTGTCTGTAGTCGGGGACGGGTTCAAGCGGCATTTTGGAAAGGTT

GAAATACCAAGTATTCAGCCCGGACAAGAAGCGAAATTATCGATTCCGGTGATGACCCTCTCGGAACTTCCGG

ACGGGTCCTACGCACAACTTGACTGGACCTTAAAGAGTTCGACCGCGTGGGCTGCTGCAGGGCACGAGGTCAC

CTCCCAGCAATTTCTCATTAAGCCTTACGCTGACAGAACTCCGTTGAAATCTTCGACTGCCCGGAAGATAAGC

ATATCCGAGCAATCATCAGCGGATCTCAAAATTCAAGGACCAAAATCCGGGTGGCATTTCGATCTGACGAAGG

GACTGTTGACATCCTGGATCAAGGGCTCGCACGAAATACTCCACAGCAGCCCTATTTTATCCTTCCATCGGGC

-continued

ACCCACTGATAACGATGGCAGTATAGCTGCTGATTGGGACGAAAAGCTCCTTCCGCTTGCGCGCCCCCACTGC

CGCTCGGTAAGTTGGAGACATGACGAAACAGCCAACACTGTGACGGTGGCGACGGAGCACCGGATTGCACCAC

CGATCTTGGAATGGGCGGTCACCGCACAAACAGAGTACGTCTTCTACGGCACTGAAGACGGCGGGGACGCTGT

GCGTATTTCGATTTCCGCCAAAGCGTCTGGCAAGAACCTCCCATCCACCTTTGCCCGCATTGGCCTTGAGTTT

GCTATCTCTTCATCGTTCCAGAACGGCCAGTGGTTCGGGCGCGGGCCTGGGGAGAGCTATCGGGACAAGAAGG

AGTCACAACGGGTGGGAAACTGGGAGATGCCTATTGATAGCCTCTGGACGGAATATGAAGTTCCACAGGAAGG

GGGCAACAGAACAGATGTAAGGTGGGTCGAGTTCTCCGGCTTTGCGCCGGAAACAGAGATTCCTATTTCGTTG

CATGCATCGTTCGTTGGGCTGCCTCAGGGCGGGAACTTCACGGCCAGCCATTTTGCAACGAAAGATGTGGCTG

AAGCCGCTCATCCTTACCAGCTTCATAGGAACAGGAGAGAGGAGGTCTTTGTCAGGCTTGACATGGATCATCA

AGGGCTTGGCACTGAGTCTTGTGGGCCGGGTGCATTGCCGCAGTATTCCTTGATCGTGGAGGAGGGATTGCAA

TGGAACTGGGGAGTGATTTTATCCTGAGAGCCATCTCTCGAATCGCGATCAATATGCAGCTAGTGAGCTGTCC

ACCGACTGCCTTGGTACATACATTACCATCAATTTCTGGCCAAGGCGTTAAAAACATTAAGAACTCGTGATCT

GTTCAAGAGTCCTCCGGATTAGAGATTGCCC

SEQ ID NO: 341
LENGTH: 3135
TYPE: DNA
ORGANISM: *M. phaseolina*
FEATURE NAME/KEY: CDS
LOCATION: (1)...(3135)

atgccgtctcaggccgagtccttctcttcgcctccggactggtgcaacctggacatcatc
 M  P  S  Q  A  E  S  F  S  S  P  P  D  W  C  N  L  D  I  I caccgcaacaccctcgcgccccgagccgccttcttcaactattcgtctccatctgccgca
 H  R  N  T  L  A  P  R  A  A  F  F  N  Y  S  S  P  S  A  A ctcttgtatgatccgcagacatcggaatacgtgaagagcctgaacggacaatggaagttc
 L  L  Y  D  P  Q  T  S  E  Y  V  K  S  L  N  G  Q  W  K  F agctacgccgtcaatccctaccgtgctccagacgggttcgagcagccagcgtttgatgca
 S  Y  A  V  N  P  Y  R  A  P  D  G  F  E  Q  P  A  F  D  A tcagcgtggcccgagatacccgttccctcgcactggcagttggaagggtatggaaagccc
 S  A  W  P  E  I  P  V  P  S  H  W  Q  L  E  G  Y  G  K  P cattacacaaacctgccatacccgttcccggtggacccgccacacgttccgctggatgaa
 H  Y  T  N  L  P  Y  P  F  P  V  D  P  P  H  V  P  L  D  E aatccgaccggtagctatctgcggaagttcacggtgccgaacggattccgcgacaaacaa
 N  P  T  G  S  Y  L  R  K  F  T  V  P  N  G  F  R  D  K  Q gtgcggctccggtttgaaggcgtggattcggcattccatgtctgggtgaacggccgagag
 V  R  L  R  F  E  G  V  D  S  A  F  H  V  W  V  N  G  R  E ttaggctactcgcaaggcgccaggaatccatctgagtttgacgtaactccgttcgtaatt
 L  G  Y  S  Q  G  A  R  N  P  S  E  F  D  V  T  P  F  V  I ttctccggggaaaacacggtcgccgtgagagtataccagtggtccgacggctcatatctc
 F  S  G  E  N  T  V  A  V  R  V  Y  Q  W  S  D  G  S  Y  L gaagatcaagaccaatggtggctcagcggcatttttcgtgacgtcaacctgatcgcgttt
 E  D  Q  D  Q  W  W  L  S  G  I  F  R  D  V  N  L  I  A  F ccgaaatctcacattcaggatttctttgtcaagactctgttagacgagaactacgagaac
 P  K  S  H  I  Q  D  F  F  V  K  T  L  L  D  E  N  Y  E  N gcagtcctccgggtagacctcacgatagagggaggcggagcggtgaccctccagcttctt
 A  V  L  R  V  D  L  T  I  E  G  G  G  A  V  T  L  Q  L  L cagaatgacaagtccaccaaggtcctggagtcctcgggcgcgccttctggagatggtacc
 Q  N  D  K  S  T  K  V  L  E  S  S  G  A  P  S  G  D  G  T ctcacgttggaattaccgcttgagaaccctcgcaaatggacggcggaagatccttacctc
 L  T  L  E  L  P  L  E  N  P  R  K  W  T  A  E  D  P  Y  L tatcaccttgttatccagctcggcgatcagacaattgcgcatagggttggatttcgcagg
 Y  H  L  V  I  Q  L  G  D  Q  T  I  A  H  R  V  G  F  R  R -continued

```
gcagaaatcaagaatggaattttcttggtcaacggcgcgaggattgtgttccggggagtc
 A  E  I  K  N  G  I  F  L  V  N  G  A  R  I  V  F  R  G  V aaccggcatgaacatcacccaacgaaggaagggcggtcggccccgagctgttacggcat
 N  R  H  E  H  H  P  T  K  G  R  A  V  G  P  E  L  L  R  H gacctccttctcatgaagaaacacaacatcaacgccatccggacgtcccaccaaccaaat
 D  L  L  L  M  K  K  H  N  I  N  A  I  R  T  S  H  Q  P  N gatacccgtctctatgagctagcggatgagctgggggttctggataatggacgaagcggac
 D  T  R  L  Y  E  L  A  D  E  L  G  F  W  I  M  D  E  A  D ctcgagacccacggctttgcatgcgtagaagaggcagcgctatcaccagaggacaagaag
 L  E  T  H  G  F  A  C  V  E  E  A  A  L  S  P  E  D  K  K aagccgtacgaggagagaaagttgatcacctacgaagcggctgcccgctggacttccgac
 K  P  Y  E  E  R  K  L  I  T  Y  E  A  A  A  R  W  T  S  D aatccggtatgggaaaaggcttacgtggaccgcatgcagcaaatggtggcgcgagacaag
 N  P  V  W  E  K  A  Y  V  D  R  M  Q  Q  M  V  A  R  D  K aatcatccgtcgattgtcatgtggagcctgggcaatgaggccttctacggatgcaatcac
 N  H  P  S  I  V  M  W  S  L  G  N  E  A  F  Y  G  C  N  H caggcgatgtacgactgggggaagaggtacgacccggacagggttatccattacgaaggc
 Q  A  M  Y  D  W  G  K  R  Y  D  P  D  R  V  I  H  Y  E  G gacatccacgctaaaaccgtcgacttgttctcattgatgtatccggagctggacacgctc
 D  I  H  A  K  T  V  D  L  F  S  L  M  Y  P  E  L  D  T  L cgggattttgcagagaaatgggacggcgcgaagccgctggtcctttgcgaatttgcgcat
 R  D  F  A  E  K  W  D  G  A  K  P  L  V  L  C  E  F  A  H gccatgggcaacgggcctggtgctttgaaagagtacgtcgagctgttctacaagcatcgg
 A  M  G  N  G  P  G  A  L  K  E  Y  V  E  L  F  Y  K  H  R tgcttgcagggtggctgggtgtgggaatgggcaaatcatggccttgaacatactagtccg
 C  L  Q  G  G  W  V  W  E  W  A  N  H  G  L  E  H  T  S  P gacagaaagaagtactacgcctatggcggtgattttggagacgaaccaaatgacgggacg
 D  R  K  K  Y  Y  A  Y  G  G  D  F  G  D  E  P  N  D  G  T ttcgtgatggatggcctggtacgctcagaccacagcattgggccaggtctggtagaatac
 F  V  M  D  G  L  V  R  S  D  H  S  I  G  P  G  L  V  E  Y aagaaagcaatcgagccagtccagctcgtctcagggagcattgaagatggctacgtggct
 K  K  A  I  E  P  Q  L  V  S  G  S  I  E  D  G  Y  V  A gtcgtcaatcggtacgacttctccaccttggaccacctggaatgccacctgtctgtagtc
 V  V  N  R  Y  D  F  S  T  L  D  H  L  E  C  H  L  S  V  V ggggacgggttcaagcggcattttggaaaggttgaaataccaagtattcagcccggacaa
 G  D  G  F  K  R  H  F  G  K  V  E  I  P  S  I  Q  P  G  Q gaagcgaaattatcgattccggtgatgaccctctcggaacttccggacgggtcctacgca
 E  A  K  L  S  I  P  V  M  T  L  S  E  L  P  D  G  S  Y  A caacttgactggaccttaaagagttcgaccgcgtgggctgctgcagggcacgaggtcacc
 Q  L  D  W  T  L  K  S  S  T  A  W  A  A  A  G  H  E  V  T tcccagcaatttctcattaagccttacgctgacagaactccgttgaaatcttcgactgcc
 S  Q  Q  F  L  I  K  P  Y  A  D  R  T  P  L  K  S  S  T  A cggaagataagcatatccgagcaatcatcagcggatctcaaaattcaaggaccaaaatcc
 R  K  I  S  I  S  E  Q  S  S  A  D  L  K  I  Q  G  P  K  S gggtggcatttcgatctgacgaagggactgttgacatcctggatcaagggctcgcacgaa
 G  W  H  F  D  L  T  K  G  L  L  T  S  W  I  K  G  S  H  E atactccacagcagccctattttatccttccatcgggcacccactgataacgatggcagt
 I  L  H  S  S  P  I  L  S  F  H  R  A  P  T  D  N  D  G  S atagctgctgattgggacgaaaagctccttccgcttgcgcgccccactgccgctcggta
 I  A  A  D  W  D  E  K  L  L  P  L  A  R  P  H  C  R  S  V agttggagacatgacgaaacagccaacactgtgacggtggcgacggagcaccggattgca
 S  W  R  H  D  E  T  A  N  T  V  T  V  A  T  E  H  R  I  A ccaccgatcttggaatgggcggtcaccgcacaaacagagtacgtcttctacggcactgaa
 P  P  I  L  E  W  A  V  T  A  Q  T  E  Y  V  F  Y  G  T  E
```

-continued

```
gacggcggggacgctgtgcgtatttcgatttccgccaaagcgtctggcaagaacctccca
 D  G  G  D  A  V  R  I  S  I  S  A  K  A  S  G  K  N  L  P tccacctttgcccgcattggccttgagtttgctatctcttcatcgttccagaacggccag
 S  T  F  A  R  I  G  L  E  F  A  I  S  S  S  F  Q  N  G  Q tggttcgggcgcgggcctggggagagctatcgggacaagaaggagtcacaacgggtggga
 W  F  G  R  G  P  G  E  S  Y  R  D  K  K  E  S  Q  R  V  G aactgggagatgcctattgatagcctctggacggaatatgaagttccacaggaaggggc
 N  W  E  M  P  I  D  S  L  W  T  E  Y  E  V  P  Q  E  G  G aacagaacagatgtaaggtgggtcgagttctccggctttgcgccggaaacagagattcct
 N  R  T  D  V  R  W  V  E  F  S  G  F  A  P  E  T  E  I  P atttcgttgcatgcatcgttcgttgggctgcctcagggcgggaacttcacggccagccat
 I  S  L  H  A  S  F  V  G  L  P  Q  G  G  N  F  T  A  S  H tttgcaacgaaagatgtggctgaagccgctcatccttaccagcttcataggaacaggaga
 F  A  T  K  D  V  A  E  A  A  H  P  Y  Q  L  H  R  N  R  R gaggaggtctttgtcaggcttgacatggatcatcaagggcttggcactgagtcttgtggg
 E  E  V  F  V  R  L  D  M  D  H  Q  G  L  G  T  E  S  C  G ccgggtgcattgccgcagtattccttgatcgtggaggagggattgcaatggaactgggga
 P  G  A  L  P  Q  Y  S  L  I  V  E  E  G  L  Q  W  N  W  G gtgattttatcctga
 V  I  L  S  -
```

SEQ ID NO: 342
LENGTH: 1044
TYPE: PRT
ORGANISM: M. phaseolina
MPSQAESFSSPPDWCNLDIIHRNTLAPRAAFFNYSSPSAALLYDPQTSEYVKSLNGQWKFSYAVNPYRAPDGF

EQPAFDASAWPEIPVPSHWQLEGYGKPHYTNLPYPFPVDPPHVPLDENPTGSYLRKFTVPNGFRDKQVRLRFE

GVDSAFHVWVNGRELGYSQGARNPSEFDVTPFVIFSGENTVAVRVYQWSDGSYLEDQDQWWLSGIFRDVNLIA

FPKSHIQDFFVKTLLDENYENAVLRVDLTIEGGGAVTLQLLQNDKSTKVLESSGAPSGDGTLTLELPLENPRK

WTAEDPYLYHLVIQLGDQTIAHRVGFRRAEIKNGIFLVNGARIVFRGVNRHEHHPTKGRAVGPELLRHDLLLM

KKHNINAIRTSHQPNDTRLYELADELGFWIMDEADLETHGFACVEEAALSPEDKKKPYEERKLITYEAAARWT

SDNPVWEKAYVDRMQQMVARDKNHPSIVMWSLGNEAFYGCNHQAMYDWGKRYDPDRVIHYEGDIHAKTVDLFS

LMYPELDTLRDFAEKWDGAKPLVLCEFAHAMGNGPGALKEYVELFYKHRCLQGGWVWEWANHGLEHTSPDRKK

YYAYGGDFGDEPNDGTFVMDGLVRSDHSIGPGLVEYKKAIEPVQLVSGSIEDGYVAVVNRYDFSTLDHLECHL

SVVGDGFKRHFGKVEIPSIQPGQEAKLSIPVMTLSELPDGSYAQLDWTLKSSTAWAAAGHEVTSQQFLIKPYA

DRTPLKSSTARKISISEQSSADLKIQGPKSGWHFDLTKGLLTSWIKGSHEILHSSPILSFHRAPTDNDGSIAA

DWDEKLLPLARPHCRSVSWRHDETANTVTVATEHRIAPPILEWAVTAQTEYVFYGTEDGGDAVRISISAKASG

KNLPSTFARIGLEFAISSSFQNGQWFGRGPGESYRDKKESQRVGNWEMPIDSLWTEYEVPQEGGNRTDVRWVE

FSGFAPETEIPISLHASFVGLPQGGNFTASHFATKDVAEAAHPYQLHRNRREEVFVRLDMDHQGLGTESCGPG

ALPQYSLIVEEGLQWNWGVILS*

SEQ ID NO: 343
LENGTH: 2473 (including 150 by 5' UTR and 150 by 3' UTR)
TYPE: DNA
ORGANISM: M. phaseolina
CCGCTATGTCCCATGCGATCCATGAGGCCAAGAGACGGTAATAGCGTTATGCCCCACCTTTCCCGCTGAGGAC

ATGTGTACCTAAACTATTTACACGACCTCCCCATCCGCTCCTTCAATCCGCCACTCCATCCATCGTTTTGAGC

AACCATGGCTGCTGACGCTTATCCCCGTCCTGATTTCCAGCGTACTAGTCTCCATTGGCAGTCTCTCAATGGC

CCTTGGGATTTCATTTTCGATGATGACGATGTCGGCCTGTCCGAGCAATGGCAGCTCAAAGGCCTCCCTGAAA

GCGTCACTGTCACTGGTGCTGCATCTTCCAAGCCAGCTTACGAGTCTGAGAACGAATCAATCACCGCCAAGAT

TGCTGCCAACACCCAGAACTTGATCAAGGATAACCTGGCCTTCCGGTCATCTAGCTCCACCACCAACAAGAAG

CGTCAGATTCAGGTTCCCTACGTCTTCCAGTGCCCGGCCTCCGGCATCAACGAGCGCGGTGACCATGAAGTCC

-continued

```
TTTGGTACCAACGTCCCCTTTCTGATCCCGCTCCGCCGAGCAGAAGAACAGGCGCGACCGGGTCATCCTCAG

GTTCGGTGCAGTCGATTATGACGCCAAGGTCTGGCTGGATGGTCACTTTGTCGGGGGCCACCGCGGGGGTCAC

GTACCTTTCGAACTGGACATCACCGACTCTTTGGACTCGAGTCCGCCTGAGCCCTTGAGGCTAACACTCCGCG

TCTATGATTCCGCGTACGACTTGACGCAACCCCGCGGAAAACAATACTGGGGCGCTAAACCGGAGAGTATATT

CTACACTCCTTCTGGCGGCATCTGGCAGCCTGTCTGGCTCGAGACTGTCCCATCTGCCAGATTGGCGGATAGC

AGCTTTGGTACCGTCTTACGCTCCAACGACATTGAGAGCGGAGACCTTCATGCCCATATTGCGTTGCTAGGTC

GCAAGGTCGGCCATAAGTACAGCATCGAGGTTGAGGCAAGTTTTGCGGGCATTCCCGTCGCCAAATCACCCAA

GAAGGATCTTCCAAAGGACAAGAATCACGTGAAGCTGGATCTGAACCTGCGTCTGTCTCAGGAGCAACTGTCT

AGTCTCCCCGATGCAGTGCGCGAAGCAGCACCACTGGGAAACGACCGATGTTGGCGGAACAGCCTGGCACTGT

GGTCACCCGACTTTCCTCAACTGTACGACTTGAAACTGCGGCTTTTTGACGTCTCGGGTAAGCTTCTGGATGA

AGTGAAGACTACCACTGGGATGCGTTCTTTGAACTGGACGCGTGGGGATGGTGCACTGCATCTCAACGACCGG

CCGATCTTCCAAGCGATGGTGCTTGACCAGGGATACTGGCCTGAGACTTTCATGACACCGCCCTCTCAGGAGC

ATCTTAAAGCGGACATTGAACTCACCAAGAGGATGGGTTTCAATGGTTGTAGGAAACACCAGAAGGTGGAAGA

TCCTGTCTTCCTTTACTGGGCTGATAGACTCGGCTTCATTGTATGGGCGAGATGGGCAATGCCTACCAGTTC

AGCCAGGAGTATGTAGAGCGCTTCAACCAGGAATGGATTGAAGCGGTCAAGAGAGACATCAACCATCCATCAA

TCATCACTTGGACCCCGGTTAATGAAAGCTGGGCATACACATCCCTTAAAGACAACATTGAACAGCGGAACCA

CATCCGAGCTCTCTACTACCTGACCAAGTAAGCCAGCAGCTACCATGTCGCAATACACACATGCTGACTCATT

TCCAGGACTCTCGATCCCACCAGGCCCATCAATGACAACTGCGGTTGGGAGCATGTGTGCACTGACCTCACGA

CTTACCATGATTACAGTGACGCCCCTGCTTTGGCAGAAACCTGCTCGACTCTGCAGGGTATCTTAGGTCCAAA

GGCAGGCCGGCCTATGTTCGTTGAGCCCATTCAAGGTTTAGATCCGGGTGCAGAGCATCGCCCTGGAGCAGTT

GTGTTGAACACCGAGTTTGGAGGCGTCAACATTGCTCCTGCCACAGGCAATTCCGCCGATGAATGGGGTTACA

CGACTGCAAGCGATCCCGATGACTTGCTTCAGAGGATTGATCGTTTGATGCGTGCTGTTGTCCAAGGCGGCCA

CTCTAGTGGTTTTGTATGGACTCAACTGTAAGTCGCCGCAGCATTCATGAGATAATCAGAGGCTAACAGGTGT

CTCCAGGGCGGATATCGAACAAGAGACCAACGGTCTTTACTCTTTCGACCGCAAAGAAAAGCTTAGTGCAGCG

AAGGTGAAAGGCGTATTGGATGAAGTTCTCAGAGTCTTTTACAGCAGCAGAGGCTTCTAGCTTAGTAACCATT

GTCACTCTTAACGTAGATAAGACGGGAAATTCAAGATGTCGGCCGCTACGTTTCACTGCTCTATTTGAACGTA

TGGTCAACTGCAACATCAATCCTATTTTCATAGAATTTGCGGGGCAAGGATGGTGGGCCACTTG

SEQ ID NO: 344
LENGTH: 2070
TYPE: DNA
ORGANISM: M. phaseolina
FEATURE NAME/KEY: CDS
LOCATION: (1)...(2070)
atggctgctgacgcttatccccgtcctgatttccagcgtactagtctccattggcagtct
  M   A   A   D   A   Y   P   R   P   D   F   Q   R   T   S   L   H   W   Q   S ctcaatggcccttgggatttcattttcgatgatgacgatgtcggcctgtccgagcaatgg
  L   N   G   P   W   D   F   I   F   D   D   D   D   V   G   L   S   E   Q   W cagctcaaaggcctccctgaaagcgtcactgtcactggtgctgcatcttccaagccagct
  Q   L   K   G   L   P   E   S   V   T   V   T   G   A   A   S   S   K   P   A tacgagtctgagaacgaatcaatcaccgccaagattgctgccaacacccagaacttgatc
  Y   E   S   E   N   E   S   I   T   A   K   I   A   A   N   T   Q   N   L   I aaggataacctggccttccggtcatctagctccaccaccaacaagaagcgtcagattcag
  K   D   N   L   A   F   R   S   S   S   T   T   N   K   K   R   Q   I   Q gttccctacgtcttccagtgcccggcctccggcatcaacgagcgcggtgaccatgaagtc
  V   P   Y   V   F   Q   C   P   A   S   G   I   N   E   R   G   D   H   E   V ctttggtaccaacgtcccctttctgatcccgctccgccgagcagaagaacaggcgcgac
  L   W   Y   Q   R   P   L   S   D   P   R   S   A   E   Q   K   N   R   R   D
```

-continued

```
cgggtcatcctcaggttcggtgcagtcgattatgacgccaaggtctggctggatggtcac
 R  V  I  L  R  F  G  A  V  D  Y  D  A  K  V  W  L  D  G  H tttgtcgggggccaccgcgggggtcacgtacctttcgaactggacatcaccgactctttg
 F  V  G  G  H  R  G  G  H  V  P  F  E  L  D  I  T  D  S  L gactcgagtccgcctgagcccttgaggctaacactccgcgtctatgattccgcgtacgac
 D  S  S  P  P  E  P  L  R  L  T  L  R  V  Y  D  S  A  Y  D ttgacgcaaccccgcggaaaacaatactggggcgctaaaccggagagtatattctacact
 L  T  Q  P  R  G  K  Q  Y  W  G  A  K  P  E  S  I  F  Y  T ccttctggcggcatctggcagcctgtctggctcgagactgtcccatctgccagattggcg
 P  S  G  G  I  W  Q  P  V  W  L  E  T  V  P  S  A  R  L  A gatagcagctttggtaccgtcttacgctccaacgacattgagagcggagaccttcatgcc
 D  S  S  F  G  T  V  L  R  S  N  D  I  E  S  G  D  L  H  A catattgcgttgctaggtcgcaaggtcggccataagtacagcatcgaggttgaggcaagt
 H  I  A  L  L  G  R  K  V  G  H  K  Y  S  I  E  V  E  A  S tttgcgggcattcccgtcgccaaatcacccaagaaggatcttccaaaggacaagaatcac
 F  A  G  I  P  V  A  K  S  P  K  K  D  L  P  K  D  K  N  H gtgaagctggatctgaacctgcgtctgtctcaggagcaactgtctagtctccccgatgca
 V  K  L  D  L  N  L  R  L  S  Q  E  Q  L  S  S  L  P  D  A gtgcgcgaagcagcaccactgggaaacgaccgatgttggcggaacagcctggcactgtgg
 V  R  E  A  A  P  L  G  N  D  R  C  W  R  N  S  L  A  L  W tcacccgactttcctcaactgtacgacttgaaactgcggcttttttgacgtctcgggtaag
 S  P  D  F  P  Q  L  Y  D  L  K  L  R  L  F  D  V  S  G  K cttctggatgaagtgaagactaccactgggatgcgttctttgaactggacgcgtgggat
 L  L  D  E  V  K  T  T  T  G  M  R  S  L  N  W  T  R  G  D ggtgcactgcatctcaacgaccggccgatcttccaagcgatggtgcttgaccagggatac
 G  A  L  H  L  N  D  R  P  I  F  Q  A  M  V  L  D  Q  G  Y tggcctgagactttcatgacaccgccctctcaggagcatcttaaagcggacattgaactc
 W  P  E  T  F  M  T  P  P  S  Q  E  H  L  K  A  D  I  E  L accaagaggatgggtttcaatggttgtaggaaacaccagaaggtggaagatcctgtcttc
 T  K  R  M  G  F  N  G  C  R  K  H  Q  K  V  E  D  P  V  F ctttactgggctgatagactcggcttcattgtatggggcgagatgggcaatgcctaccag
 L  Y  W  A  D  R  L  G  F  I  V  W  G  E  M  G  N  A  Y  Q ttcagccaggagtatgtagagcgcttcaaccaggaatggattgaagcggtcaagagagac
 F  S  Q  E  Y  V  E  R  F  N  Q  E  W  I  E  A  V  K  R  D atcaaccatccatcaatcatcacttggaccccggttaatgaaagctgggcatacacatcc
 I  N  H  P  S  I  I  T  W  T  P  V  N  E  S  W  A  Y  T  S cttaaagacaacattgaacagcggaaccacatccgagctctctactacctgaccaagact
 L  K  D  N  I  E  Q  R  N  H  I  R  A  L  Y  Y  L  T  K  T ctcgatccaccaggcccatcaatgacaactgcggttgggagcatgtgtgcactgacctc
 L  D  P  T  R  P  I  N  D  N  C  G  W  E  H  V  C  T  D  L acgacttaccatgattacagtgacgcccctgctttggcagaaacctgctcgactctgcag
 T  T  Y  H  D  Y  S  D  A  P  A  L  A  E  T  C  S  T  L  Q ggtatcttaggtccaaaggcaggccggcctatgttcgttgagcccattcaaggtttagat
 G  I  L  G  P  K  A  G  R  P  M  F  V  E  P  I  Q  G  L  D ccgggtgcagagcatcgccctggagcagttgtgttgaacaccgagtttggaggcgtcaac
 P  G  A  E  H  R  P  G  A  V  V  L  N  T  E  F  G  G  V  N attgctcctgccacaggcaattccgccgatgaatgggggttacacgactgcaagcgatccc
 I  A  P  A  T  G  N  S  A  D  E  W  G  Y  T  T  A  S  D  P gatgacttgcttcagaggattgatcgtttgatgcgtgctgttgtccaaggcggccactct
 D  D  L  L  Q  R  I  D  R  L  M  R  A  V  V  Q  G  G  H  S agtggttttgtatggactcaactggcggatatcgaacaagagaccaacggtctttactct
 S  G  F  V  W  T  Q  L  A  D  I  E  Q  E  T  N  G  L  Y  S
```

```
ttcgaccgcaaagaaaagcttagtgcagcgaaggtgaaaggcgtattggatgaagttctc
 F  D  R  K  E  K  L  S  A  A  K  V  K  G  V  L  D  E  V  L agagtcttttacagcagcagaggcttctag
 R  V  F  Y  S  S  R  G  F  -
```

SEQ ID NO: 345
LENGTH: 689
TYPE: PRT
ORGANISM: *M. phaseolina*
MAADAYPRPDFQRTSLHWQSLNGPWDFIFDDDDVGLSEQWQLKGLPESVTVTGAASSKPAYESENESITAKIA

ANTQNLIKDNLAFRSSSSTTNKKRQIQVPYVFQCPASGINERGDHEVLWYQRPLSDPRSAEQKNRRDRVILRF

GAVDYDAKVWLDGHFVGGHRGGHVPFELDITDSLDSSPPEPLRLTLRVYDSAYDLTQPRGKQYWGAKPESIFY

TPSGGIWQPVWLETVPSARLADSSFGTVLRSNDIESGDLHAHIALLGRKVGHKYSIEVEASFAGIPVAKSPKK

DLPKDKNHVKLDLNLRLSQEQLSSLPDAVREAAPLGNDRCWRNSLALWSPDFPQLYDLKLRLFDVSGKLLDEV

KTTTGMRSLNWTRGDGALHLNDRPIFQAMVLDQGYWPETFMTPPSQEHLKADIELTKRMGENGCRKHQKVEDP

VFLYWADRLGFIVWGEMGNAYQFSQEYVERFNQEWIEAVKRDINHPSIITWTPVNESWAYTSLKDNIEQRNHI

RALYYLTKTLDPTRPINDNCGWEHVCTDLTTYHDYSDAPALAETCSTLQGILGPKAGRPMFVEPIQGLDPGAE

HRPGAVVLNTEFGGVNIAPATGNSADEWGYTTASDPDDLLQRIDRLMRAVVQGGHSSGFVWTQLADIEQETNG

LYSFDRKEKLSAAKVKGVLDEVLRVFYSSRGF*

SEQ ID NO: 346
LENGTH: 3651 (including 150 by 5' UTR and 150 by 3' UTR)
TYPE: DNA
ORGANISM: *M. phaseolina*
TGGTAGCTTTTTTTCTCCCCCGGAATCTCCGGTCCAGCAGCTCTACTTTTCCCGCTCGTCGAGGAAGTAAGCT

CTGCTGTTGCTGCGTCGTCTTTTTGCTCTCCGCACTGCGTTTTGAAGCTTCGTCCGTCATTGTCGAAGCTTGA

GACCATGAAGCTCACCAGCAGCTTGCTGGCCGCCGGCCTGGCGTCCCAGGCGCTAGGTTACGTCGTTGGCGGT

AAGCCAAAGGACTTGATCAAGCCATACAAGCGTGAGGCTCTGCAGGATATTGTGTGTCTTTCTCCTTATCTTT

GGAGCTAGCGGCTCGTCCGGGAAACAAGCTCACTGACTTGCCGGGAACAGGTCACTTGGGACGAGCACTCGCT

GTTTGTCAACGGCGAGCGTATCATCTTCCTTAGCGGCGAATACCACCCGTTCAGGTACGATTGACCCCACACA

CTGTCTCAATGGCCGGCCACTGGACCTCAGTTCTGACGCCCAAAAATCCAGACTTCCCGTCCCCTCGCTGTGG

CTTGACGTTTTCCACAAGATCAAGGCGCTCGGTTTCAACGGCGTGTCCTTCTATGTTGACTGGGCTTTGCTGG

AGGGCACTCCTGGCGAGTTCACTGCCGAGGGTGTGTTCGCTTGGGAGCCCTTTTTCGACGCCGCGCAAGAGGC

CGGAATCTATCTTCTCGCTGTGAGCCACCCTCAGTGGATTCTCTACTGACTCATGCTAATCGTATGAAGCGCC

CTGGCCCATACATCAACGCTGAGGTCTCCGGTGGTGGCTTCCCTGGTTGGCTCCAGCGTGTCAACGGCACCCT

GAGGACGGACGACCCCGGCTACATCAATGCCACTGACAAGTATGTGACCCATGCTCTCAACGCTATTTGGTCC

TTGGCCCACCTAACATAACCTTCTTAGCTACGCCCGCTCGATCGGAGAGATTATCGCCAAGGCCCAGATCACC

AACGGCGGCCCCGTCATTCTCTTCCAACCCGAGAACGAGTACACCGGTGCCACCGACAACGTCGAATTCCCCA

ACGAGAACTATTGGGCTATCGTTGAGAAGCAGTTCAGGGACGCAGGTATCGTTGTGCCATACATCAATAACGA

TGCCTCTCCCCAAGGATACTTCGCCCCTGGCTCCAACTGGACTCCTCAGGTCGATATTTACGGCCATGATGGA

TACCCGCTCGGATTCGATTGCGCCAATCCTTACACTTGGCCTGATGGCAAGCTGCCCACTAACTGGAAAACTC

TCCATGAACAGCAAAGCCCGAGCACGCCTTACTCTGTCATCGAGGTAAGCTCGAGCTCTTGAATGATGTCGGA

TATAGCTGACACAATGGACAGTTCCAAGGTGGTGCCTTTGACCCCTGGGGTGGTCTTGGTTTTGACCAGTGCT

CTGTTCTGCTCAACCACGAGTTCGAACGTGTCTTCTACAAGAACCTCCAGAGCTTTGGTGTTACTATCCTGAA

CCTCTACATGGTGAGACGAGAAAACCCTATTTTACAATTCGACTCAGTTCTAATCGTCATGCAGATTTTCGGT

GGAACCAACTGGGGTAATCTCGGCCACCCCGGCGGCTACACTTCTTACGACTACGGCTCAGTCATCAGGGAGA

CTCGTGAGATTAACCGCGAGAAGTACAGCGAGTTGAAGCTTCAGGGCAACTTTCTGAAGGTGTCTCCCGCCTA

CTTGACTGCTGAGCCTGGTGACCTTTCCAACGGTTCCTACGCCGACACTTCTGACATTGCTGTCACGCCCCTC

-continued

CTGGGCAACACCACCAACTTCTTCGTTGTCAGACATGCTGCCTACAACTCCTTGGAGTCGACTCCCTACACCA

TCACACTACCAACCAGCGCTGGAGATCTTACCATCCCGCAGCTGAACGGCACCCTGACCCTGAATGGCCGCGA

TTCCAAGGTCCACGTCACCGACTACGACGTGGGTGGTGAGAATCTCCTTTACTCTACCGCTGAGATCTTCACT

TGGAAGGCCTACGATGACAAGACCGTGCTGGTCGTCTACGGAGGTCCTGGCGAGTCTCACGAGCTCGCCTTCT

CCAGCGGCAAGAACGCTACCATCGTTGAGGGCTCTGGTGTGACTATCGCACCTAAGGGCGGTGCCACTCTCCT

ACACTGGTCTGTCACGCCGACGCGCAAGGTCGTCAAGGTGGGAGAGAGCCTGTACGTCTATATTCTCGACCGC

AACTCTGCCTACAACTATTGGACCCACGACGACATTGTCCTCAAGGCTGGTTACCTCATCCGCAACGCCACCG

TCGATGGCACTACGCTCTCCGTTGTCGGTGATCTCAACGCTACTACCACCCTCGAGGTTATTGGCGGCGCTCC

TTCTGGTCTAACCAAGCTCACCTTCAACGGTGAGGATGTTGCCTTCAACCAGTCCTCTTTGGGCAATGTCGCC

GCAACTCTGCAGTACACTCCTCCGGCAATTAGCCTCCCTGACCTGTCCTCCCTCTCCTGGAAGAGCATCGATT

CTCTCCCAGAGATCCAGACTGACTACGACGACTCGGCCTGGCCCGCCGCCGACTTGCCTACTACCTACAATAC

CCTTCGTCCCATTACCACGCCGACCAGCCTCTACGGCAGTGACTACGGTTACCACTATGGTACCCTCCTCTTC

CGTGGTCACTTCACCGCCACCGGCTCTGAGACTTCGTTGTCTATCTCCGCGCAGGGTGGCTTTGCCTCGGGTT

TCACCGTCTTCCTGAACAGTGTCGCCCTTGGCTCGTGGAAGGGTGCTGACTACGCCTCAAATGGCAACTTGAC

CCTCTCTATCCCCTCGTCCGCCGTTCCCACGAGTGGCTCTGAAGCCGTCATCACCGTCGTTCTCGACACAACC

GGAATCAGCGAGAACTGGGTCACTGGCGCCGAAGAAGCTAAGCTCCCGCGCGGCATCCTCAATTACGACCTCG

CCGGCCACGACGCAAGCGATGTCACCTGGAAGCTGACCGGCAACCTCGGCGGCGAGAAGTACATCGACAAGTC

GCGCGGCCCGCTGAACGAGGGCGGTCTCTTTGCCGAGCGCCAGGGCTACCACCTCCCCGGCGCGCCCACCGAC

GACTGGTCCGCCAGCGAGGGTCCCGCCGCTGACGGTGTCGAGGGCGTCGGAGTCAAGTGGTACGCCACCACCA

TCGACCTCGACATCCCGACCGGCTGGGATGTGCCCATCAGCTTCTCCTTCGCCAACTCTACTAGCAACGCAAC

CGACGCCGACGGCCTCGCCAAGGCATACCGCGTACAGCTGTTCGTCAACGGCTGGCAGTTTGGCAAGTACGTC

CACAACATCGGCCCCCAGGACGTCTTCCCCGTCCCCGAGGGCATCTGGGACTACAGGGGCAGCAACTACGTCG

CTGTCAGCTTGTTCAGCCAAGAGGAGAGCGGCGCCACGGTTGATGGGTTCGAATTGGTGCATGGGACGCCCGT

CAAGACCGGGTACCAGGCGGTTGAGGTTGTGCAAGGTGAGACGTTTGCGGAGCGTGCGGGGGCGTACTGACGG

GAGCCGAGTGATGAGGAGATGTGGTTGGGAGATGGAGAGCTGAGATGATTGAAAGTCcATCTTCTTGAGATAT

GAGTTAATGATATGATTCTGTCATGAATGAATGGTCCATCCAAACGCATCCAGCCAGACTAAATGCACACATGC

SEQ ID NO: 347
LENGTH: 2994
TYPE: DNA
ORGANISM: *M. phaseolina*
FEATURE NAME/KEY: CDS
LOCATION: (1)...(2994)

atgaagctcaccagcagcttgctggccgccggcctggcgtcccaggcgctaggttacgtc
 M  K  L  T  S  S  L  L  A  A  G  L  A  S  Q  A  L  G  Y  V gttggcggtaagccaaaggacttgatcaagccatacaagcgtgaggctctgcaggatatt
 V  G  G  K  P  K  D  L  I  K  P  Y  K  R  E  A  L  Q  D  I gtcacttgggacgagcactcgctgtttgtcaacggcgagcgtatcatcttccttagcggc
 V  T  W  D  E  H  S  L  F  V  N  G  E  R  I  I  F  L  S  G gaataccacccgttcagacttcccgtcccctcgctgtggcttgacgttttccacaagatc
 E  Y  H  P  F  R  L  P  V  P  S  L  W  L  D  V  F  H  K  I aaggcgctcggtttcaacggcgtgtccttctatgttgactgggctttgctggagggcact
 K  A  L  G  F  N  G  V  S  F  Y  V  D  W  A  L  L  E  G  T cctggcgagttcactgccgagggtgtgttcgcttgggagcccttttttcgacgccgcgcaa
 P  G  E  F  T  A  E  G  V  F  A  W  E  P  F  F  D  A  A  Q gaggccggaatctatcttctcgctcgccctggcccatacatcaacgctgaggtctccggt
 E  A  G  I  Y  L  L  A  R  P  G  P  Y  I  N  A  E  V  S  G ggtggcttccctggttggctccagcgtgtcaacggcaccctgaggacggacgaccccggc
 G  G  F  P  G  W  L  Q  R  V  N  G  T  L  R  T  D  D  P  G -continued

```
tacatcaatgccactgacaactacgcccgctcgatcggagagattatcgccaaggcccag
 Y  I  N  A  T  D  N  Y  A  R  S  I  G  E  I  I  A  K  A  Q atcaccaacggcggccccgtcattctcttccaacccgagaacgagtacaccggtgccacc
 I  T  N  G  G  P  V  I  L  F  Q  P  E  N  E  Y  T  G  A  T gacaacgtcgaattccccaacgagaactattgggctatcgttgagaagcagttcaggac
 D  N  V  E  F  P  N  E  N  Y  W  A  I  V  E  K  Q  F  R  D gcaggtatcgttgtgccatacatcaataacgatgcctctccccaaggatacttcgcccct
 A  G  I  V  V  P  Y  I  N  N  D  A  S  P  Q  G  Y  F  A  P ggctccaactggactcctcaggtcgatatttacggccatgatggatacccgctcggattc
 G  S  N  W  T  P  Q  V  D  I  Y  G  H  D  G  Y  P  L  G  F gattgcgccaatccttacacttggcctgatggcaagctgcccactaactggaaaactctc
 D  C  A  N  P  Y  T  W  P  D  G  K  L  P  T  N  W  K  T  L catgaacagcaaagcccgagcacgccttactctgtcatcgagttccaaggtggtgccttt
 H  E  Q  Q  S  P  S  T  P  Y  S  V  I  E  F  Q  G  G  A  F gaccctggggtggtcttggttttgaccagtgctctgttctgctcaaccacgagttcgaa
 D  P  W  G  G  L  G  F  D  Q  C  S  V  L  L  N  H  E  F  E cgtgtcttctacaagaacctccagagctttggtgttactatcctgaacctctacatgatt
 R  V  F  Y  K  N  L  Q  S  F  G  V  T  I  L  N  L  Y  M  I ttcggtggaaccaactggggtaatctcggccaccccggcggctacacttcttacgactac
 F  G  G  T  N  W  G  N  L  G  H  P  G  G  Y  T  S  Y  D  Y ggctcagtcatcagggagactcgtgagattaaccgcgagaagtacagcgagttgaagctt
 G  S  V  I  R  E  T  R  E  I  N  R  E  K  Y  S  E  L  K  L cagggcaactttctgaaggtgtctcccgcctacttgactgctgagcctggtgacctttcc
 Q  G  N  F  L  K  V  S  P  A  Y  L  T  A  E  P  G  D  L  S aacggttcctacgccgacacttctgacattgctgtcacgcccctcctgggcaacaccacc
 N  G  S  Y  A  D  T  S  D  I  A  V  T  P  L  L  G  N  T  T aacttcttcgttgtcagacatgctgcctacaactccttggagtcgactcctacaccatc
 N  F  F  V  V  R  H  A  A  Y  N  S  L  E  S  T  P  Y  T  I acactaccaaccagcgctggagatcttaccatcccgcagctgaacggcaccctgaccctg
 T  L  P  T  S  A  G  D  L  T  I  P  Q  L  N  G  T  L  T  L aatggccgcgattccaaggtccacgtcaccgactacgacgtgggtggtgagaatctcctt
 N  G  R  D  S  K  V  H  V  T  D  Y  D  V  G  G  E  N  L  L tactctaccgctgagatcttcacttggaaggcctacgatgacaagaccgtgctggtcgtc
 Y  S  T  A  E  I  F  T  W  K  A  Y  D  D  K  T  V  L  V  V tacggaggtcctggcgagtctcacgagctcgccttctccagcggcaagaacgctaccatc
 Y  G  G  P  G  E  S  H  E  L  A  F  S  S  G  K  N  A  T  I gttgagggctctggtgtgactatcgcacctaagggcggtgccactctcctacactggtct
 V  E  G  S  G  V  T  I  A  P  K  G  G  A  T  L  L  H  W  S gtcacgccgacgcgcaaggtcgtcaaggtgggagagagcctgtacgtctatattctcgac
 V  T  P  T  R  K  V  V  K  V  G  E  S  L  Y  V  Y  I  L  D cgcaactctgcctacaactattggacccacgacgacattgtcctcaaggctggttacctc
 R  N  S  A  Y  N  Y  W  T  H  D  D  I  V  L  K  A  G  Y  L atccgcaacgccaccgtcgatggcactacgctctccgttgtcggtgatctcaacgctact
 I  R  N  A  T  V  D  G  T  T  L  S  V  V  G  D  L  N  A  T accaccctcgaggttattggcggcgctccttctggtctaaccaagctcaccttcaacggt
 T  T  L  E  V  I  G  G  A  P  S  G  L  T  K  L  T  F  N  G gaggatgttgccttcaaccagtcctctttgggcaatgtcgccgcaactctgcagtacact
 E  D  V  A  F  N  Q  S  S  L  G  N  V  A  A  T  L  Q  Y  T cctccggcaattagcctccctgacctgtcctccctctcctggaagagcatcgattctctc
 P  P  A  I  S  L  P  D  L  S  S  L  S  W  K  S  I  D  S  L ccagagatccagactgactacgacgactcggcctggcccgccgccgacttgcctactacc
 P  E  I  Q  T  D  Y  D  D  S  A  W  P  A  A  D  L  P  T  T tacaatacccttcgtcccattaccacgccgaccagcctctacggcagtgactacggttac
 Y  N  T  L  R  P  I  T  T  P  T  S  L  Y  G  S  D  Y  G  Y
```

```
cactatggtaccctcctcttccgtggtcacttcaccgccaccggctctgagacttcgttg
 H   Y   G   T   L   L   F   R   G   H   F   T   A   T   G   S   E   T   S   L tctatctccgcgcagggtggctttgcctcgggtttcaccgtcttcctgaacagtgtcgcc
 S   I   S   A   Q   G   G   F   A   S   G   F   T   V   F   L   N   S   V   A cttggctcgtggaagggtgctgactacgcctcaaatggcaacttgaccctctctatcccc
 L   G   S   W   K   G   A   D   Y   A   S   N   G   N   L   T   L   S   I   P tcgtccgccgttcccacgagtggctctgaagccgtcatcaccgtcgttctcgacacaacc
 S   S   A   V   P   T   S   G   S   E   A   V   I   T   V   V   L   D   T   T ggaatcagcgagaactgggtcactggcgccgaagaagctaagctcccgcgcggcatcctc
 G   I   S   E   N   W   V   T   G   A   E   E   A   K   L   P   R   G   I   L aattacgacctcgccggccacgacgcaagcgatgtcacctggaagctgaccggcaacctc
 N   Y   D   L   A   G   H   D   A   S   D   V   T   W   K   L   T   G   N   L ggcggcgagaagtacatcgacaagtcgcgcggcccgctgaacgagggcggtctctttgcc
 G   G   E   K   Y   I   D   K   S   R   G   P   L   N   E   G   G   L   F   A gagcgccagggctaccacctccccggcgcgcccaccgacgactggtccgccagcgagggt
 E   R   Q   G   Y   H   L   P   G   A   P   T   D   D   W   S   A   S   E   G cccgccgctgacggtgtcgagggcgtcggagtcaagtggtacgccaccaccatcgacctc
 P   A   A   D   G   V   E   G   V   G   V   K   W   Y   A   T   T   I   D   L gacatccccaccggctgggatgtgcccatcagcttctccttcgccaactctactagcaac
 D   I   P   T   G   W   D   V   P   I   S   F   S   F   A   N   S   T   S   N gcaaccgacgccgacggcctcgccaaggcataccgcgtacagctgttcgtcaacggctgg
 A   T   D   A   D   G   L   A   K   A   Y   R   V   Q   L   F   V   N   G   W cagtttggcaagtacgtccacaacatcggcccccaggacgtcttccccgtccccgagggc
 Q   F   G   K   Y   V   H   N   I   G   P   Q   D   V   F   P   V   P   E   G atctgggactacaggggcagcaactacgtcgctgtcagcttgttcagccaagaggagagc
 I   W   D   Y   R   G   S   N   Y   V   A   V   S   L   F   S   Q   E   E   S ggcgccacggttgatgggttcgaattggtgcatggacgcccgtcaagaccgggtaccag
 G   A   T   V   D   G   F   E   L   V   H   G   T   P   V   K   T   G   Y   Q gcggttgaggttgtgcaaggtgagacgtttgcggagcgtgcgggggcgtactga
 A   V   E   V   V   Q   G   E   T   F   A   E   R   A   G   Y   -

SEQ ID NO: 348
LENGTH: 997
TYPE: PRT
ORGANISM: M. phaseolina
MKLTSSLLAAGLASQALGYVVGGKPKDLIKPYKREALQDIVTWDEHSLFVNGERIIFLSGEYHPFRLPVPSLW

LDVFHKIKALGFNGVSFYVDWALLEGTPGEFTAEGVFAWEPFFDAAQEAGIYLLARPGPYINAEVSGGGFPGW

LQRVNGTLRTDDPGYINATDNYARSIGEIIAKAQITNGGPVILFQPENEYTGATDNVEFPNENYWAIVEKQFR

DAGIVVPYINNDASPQGYFAPGSNWTPQVDIYGHDGYPLGFDCANPYTWPDGKLPTNWKTLHEQQSPSTPYSV

IEFQGGAFDPWGGLGFDQCSVLLNHEFERVFYKNLQSFGVTILNLYMIFGGTNWGNLGHPGGYTSYDYGSVIR

ETREINREKYSELKLQGNFLKVSPAYLTAEPGDLSNGSYADTSDIAVTPLLGNTTNFFVVRHAAYNSLESTPY

TITLPTSAGDLTIPQLNGTLTLNGRDSKVHVTDYDVGGENLLYSTAEIFTWKAYDDKTVLVVYGGPGESHELA

FSSGKNATIVEGSGVTIAPKGGATLLHWSVTPTRKVVKVGESLYVYILDRNSAYNYWTHDDIVLKAGYLIRNA

TVDGTTLSVVGDLNATTTLEVIGGAPSGLTKLTFNGEDVAFNQSSLGNVAATLQYTPPAISLPDLSSLSWKSI

DSLPEIQTDYDDSAWPAADLPTTYNTLRPITTPTSLYGSDYGYHYGTLLFRGHFTATGSETSLSISAQGGFAS

GFTVFLNSVALGSWKGADYASNGNLTLSIPSSAVPTSGSEAVITVVLDTTGISENWVTGAEEAKLPRGILNYD

LAGHDASDVTWKLTGNLGGEKYIDKSRGPLNEGGLFAERQGYHLPGAPTDDWSASEGPAADGVEGVGVKWYAT

TIDLDIPTGWDVPISFSFANSTSNATDADGLAKAYRVQLFVNGWQFGKYVHNIGPQDVFPVPEGIWDYRGSNY

VAVSLFSQEESGATVDGFELVHGTPVKTGYQAVEVVQGETFAERAGY*
```

-continued

SEQ ID NO: 349
LENGTH: 3452 (including 150 bp 5' UTR and 150 bp 3' UTR)
TYPE: DNA
ORGANISM: M. phaseolina

CCAGGCCCTTTGATTGATGGATCTTGTGCCTGGCCATGGCCCGCATACCGTATTTTTGTATGACTTCATGGGC

TGTGGTTCCATTAAGTATACGCTGATGGAAGGCGTACTTCGCCGCTCCCTGCTCCTTCATCTCCTTCACCGGC

AGCCATGCGCGCCCTTACGGCTCTGCTGCTCCTCCTGGGCGCAGTTACCTCCCTCGTTTGCGCGCAGAGAGAC

AATGGTTACAGCGACGTTGTCCAGTGGGACGAAAACAGCTTGTTCATCAATGGCGAGCGCGTCTATATCTACT

CCGGCGAGTTCCACTACGCCCGTCTTCCGGTGCCGGAATTGTGGCGTGATATTATACAGAAGTACAAGGCAAA

CGGCTTGAACACCCTCAGGTACGCTCGACTCCCCAGTAATCCCGCCTCGCCATACTGATCCTCGTAGCATCTA

CTTCTTCTGGTCGTACCACTCGCCTTCCAAGGGTGTTTTCGACTTCGAATCTCCCGGCAAAGACATCCAGAAG

CTCTTTGACATCGCGAAGGAAGAGGGAGTCTACATTATCGCTCGCCCCGGCCCTTACTGCAACGCGGAGACCA

GCGCTGGTGGATACGGACTTTATCTCACAGACGGCAGCGGCGGCGACGTCCGAACCAACGACGAGACATACCA

CGAGCAATGGCTGCCCTGGATCAACGCCGTTCTACCGATCATCGCTCGCAACCAAATCACCGAGGGTGGACCT

GTCATTCTTGTCCAAGTCGAGAACGAGCTGACGCAATCACGTCATGTGGCCACCGACCCTCTGGTCTTATACA

TGGAGCAGCTCAAGAAGGCCTTCAGAGACAACGGCATAGTCGTCCCTTTCACATCGAACGAGAAGGGCATGCG

CGGTCAGAGTTGGTCAACCGACTACCAGAATGTGGGCGGAGCTGTGGATATCTATGGTCTCGACAGCTATGCC

GGTGGCCTCAGCTGCTCGAATATCGATACTGGATTTACCATCGTCCGCACTTACTATCAATGGTTCCAGAACT

ACTCATACACGCAGCCTGAGTTCACTCCTGAATTCAAAGGTGGCTGGTTCCAGCCATGGGGCGGCTACTTCTT

CGACGACTGCATCTCGGAGCATGACACGGCTTATCCGGATGTGTTCTACAAGAACAACATAGCCCAGAGGCTG

ACGCTTCAGAACATGTATATGACATATGGAGGAACGAATTGGGGCCACCTCGCAGCGCCAGTGGTATTTTGGG

ATCCTGTCACACCGAATTTTTATCTATGGAGGACTGACGACGATTAGGTATACACTTCGTACGACTACGGAGC

ACCGCTCAGAGAGACGCGCGAAATCTGGGACAAGTTCAAGCATATCAAGCTCATCAGCTTGTTCACTAGGGTC

AGCGAGGGTCTTCTCAACACCGACATGGAAAGTAACGGCACCGGAAACGCCGTCAACACTTCGTCGATTTTCA

CTTGGGTCCTTCGCAATCCCGAGACCTCGGCAGGCTTCTACGTTACGCAACACGACAACTCCAGGTCTCGCGA

GAACACCCCTTTCTCTTTGAACCTCGCCACGTCCGAGGGCGCAGTTACTGTACCGAGTCTTGATTTGCGCGGC

CGTCAAAGCAGGATAGTGGTTACCGATTACCCTGTCGGGGATTACACACTTTTGTACTCATCTGCCGAGGTCT

TGACCTACGGAGTGTTTGACGTGCCTGTTATCGTCTTCTACCTCAACAGAGGCCAAGTGGGAGAGCTTGCCTT

CAAGGGAGGCCTCAAGAACACAAACTTCACCACCTACGGCGCTGAGACGGACTTCACTGCCACCGCCGCCGGC

AACGACACGTCCGCAGCCTTCAAGTACACTCAGTCCGAGGGCGCCACCGTCATCAAATTCGCCAACGGACCGG

TGCTATACCTCCTCGAAAGATGGGCCGCATACACCTTCTTCGCGCCAGCCATGACCTCGAACCCGCACATCGC

CGCCGACGAGCAGATCTTCGTGCTTGGGCCCTACCTCGTCCGCAGCGCCAGCGTCACCGGCAGCACCGTCTCC

ATATCGGGCGACCACCTCAACGACACCAGCATCGACGTCTACGTCGGCGACCCCTCCGTCACCAGCATCAGCT

GGAACGGCGCCGCGCTCGCGACGACGCGCTCTGCCTACGGCTCGCTGCAGGCTTCGCTGCCGGGCATCCTCGA

CCGCGTCGTCGCGCTGCCCGCTCTGACGGGCTGGAGGGTCGCCGACGCCCTGCCTGAGGCCGACCCGGCCTAT

GACGACTCGCGCTGGACCGTCGCCAACAAGACAACCACCCTCAGCCCGCTCGCGCCGCTCACGCTGCCCGTGC

TGTACGGCGCCGACTACGGCTTCTACGCCGGCGTCCTGCTGTACCGCGGCCACTTTGCTGGAGCTGGCGCGAC

TGGCGCGAACGTCACCGTGCAAGGCGGCGTCGCGGCGGGGTGGTCGGCATGGCTGAATGGCAAGCTGGTCGGC

GGCCACCCCGGCAACGCGTCGCTGCTCCAGACGTCCGTCGTGCTGGACTTCGCCGGCGCCGAGCTGAGAGAGG

AGGGAAATGTTTTGACTGTGGTGACGGACTATACTGGGCACGACCAGGACAGCCAGGGACCCTACGGCCCGCT

AAACCCCCGGGGCATCCTGGGCGCGAAGCTGATCGGCACGAGCAACGCCACGAATTCGAGTGCGCCGGTGTTC

GAGCAGTGGAAGATTCAGGGGAATGCGGGAGGTGGCGCGGGATATATCGATCCGGTGCGTGGGCCGATGAATG

AGGGTGGACTGCATGGCGAGCGGTTGGGATGGCATTTGCCTGGGTTCGATACCGCGCAGTGGGAGGAGGGCGA

-continued
TCCACTCGAGGGGTTCAAGGGCGCAGGCATCAAATGGTACAGGACGGAGTTTGACCTCGATGTGGACGAGGAC

CTGGATGCGCCGATTGGGCTGGAAGTGAGCATTCCGGATGGGACAGTGGCGAGGGTGCAGATCTTCATCAATG

GGTGAGTTTGGCTTGCAGCCTCGGTGTTGGCTTTTGGAGTCTTTTACTGACGGCATGAACAGTTACCAGTATG

GCAAGTATCTGCCGCATATTGGCCCGCAGACGAAGTTTCCCTTCCCGCCCGGTGTGCTGAACAACCGCGGAAC

GAATAGTCTGTCACTCAGTGTTTGGGCGCAGACGGAAGAGGGTGTCGCGTTCGATAAGGTGGATCTCGTCTTG

TACGGGAAGTACCAGTCCGACTTTGGGTTTTCGAGGGATTGGAGCGCGCTCCAGCCGGGCTGGTCGGAGGAGC

GCCTGCAGTATGCGTAGAGAAGGAGATACTGCAGAGTTTCGTACAGTACATATATATGCGGCTTGGGTGCCTT

GTTAAAAAAAATGAAAAAAAAAATAAGGTCAATGAAAAGGGCAAAGTGAAACCCGCTGCTTCATCTGATGCA

TGTTGGAAAGACCAGACCAGC

SEQ ID NO: 350
LENGTH: 2985
TYPE: DNA
ORGANISM: M. phaseolina
FEATURENAME/KEY: CDS
LOCATION: (1)...(2985)

```
atgcgcgcccttacggctctgctgctcctcctgggcgcagttacctccctcgtttgcgcg
 M   R   A   L   T   A   L   L   L   L   L   G   A   V   T   S   L   V   C   A cagagagacaatggttacagcgacgttgtccagtgggacgaaaacagcttgttcatcaat
 Q   R   D   N   G   Y   S   D   V   V   Q   W   D   E   N   S   L   F   I   N ggcgagcgcgtctatatctactccggcgagttccactacgcccgtcttccggtgccggaa
 G   E   R   V   Y   I   Y   S   G   E   F   H   Y   A   R   L   P   V   P   E ttgtggcgtgatattatacagaagtacaaggcaaacggcttgaacaccctcagcatctac
 L   W   R   D   I   I   Q   K   Y   K   A   N   G   L   N   T   L   S   I   Y ttcttctggtcgtaccactcgccttccaagggtgttttcgacttcgaatctcccggcaaa
 F   F   W   S   Y   H   S   P   S   K   G   V   F   D   F   E   S   P   G   K gacatccagaagctctttgacatcgcgaaggaagagggagtctacattatcgctcgcccc
 D   I   Q   K   L   F   D   I   A   K   E   E   G   V   Y   I   I   A   R   P ggcccttactgcaacgcggagaccagcgctggtggatacggactttatctcacagacggc
 G   P   Y   C   N   A   E   T   S   A   G   G   Y   G   L   Y   L   T   D   G agcggcggcgacgtccgaaccaacgacgagacataccacgagcaatggctgccctggatc
 S   G   G   D   V   R   T   N   D   E   T   Y   H   E   Q   W   L   P   W   I aacgccgttctaccgatcatcgctcgcaaccaaatcaccgagggtggacctgtcattctt
 N   A   V   L   P   I   I   A   R   N   Q   I   T   E   G   G   P   V   I   L gtccaagtcgagaacgagctgacgcaatacgtcatgtggccaccgaccctctggtctta
 V   Q   V   E   N   E   L   T   Q   S   R   H   V   A   T   D   P   L   V   L tacatggagcagctcaagaaggccttcagagacaacggcatagtcgtccctttcacatcg
 Y   M   E   Q   L   K   K   A   F   R   D   N   G   I   V   V   P   F   T   S aacgagaagggcatgcgcggtcagagttggtcaaccgactaccagaatgtgggcggagct
 N   E   K   G   M   R   G   Q   S   W   S   T   D   Y   Q   N   V   G   G   A gtggatatctatggtctcgacagctatgccggtggcctcagctgctcgaatatcgatact
 V   D   I   Y   G   L   D   S   Y   A   G   G   L   S   C   S   N   I   D   T ggatttaccatcgtccgcacttactatcaatggttccagaactactcatacacgcagcct
 G   F   T   I   V   R   T   Y   Y   Q   W   F   Q   N   Y   S   Y   T   Q   P gagttcactcctgaattcaaaggtggctggttccagccatggggcggctacttcttcgac
 E   F   T   P   E   F   K   G   G   W   F   Q   P   W   G   G   Y   F   F   D gactgcatctcggagcatgacacggcttatccggatgtgttctacaagaacaacatagcc
 D   C   I   S   E   H   D   T   A   Y   P   D   V   F   Y   K   N   N   I   A cagaggctgacgcttcagaacatgtatatgacatatggaggaacgaattggggccacctc
 Q   R   L   T   L   Q   N   M   Y   M   T   Y   G   G   T   N   W   G   H   L gcagcgccagtggtatacacttcgtacgactacggagcaccgctcagagagacgcgcgaa
 A   A   P   V   V   Y   T   S   Y   D   Y   G   A   P   L   R   E   T   R   E atctgggacaagttcaagcatatcaagctcatcagcttgttcactagggtcagcgagggt
 I   W   D   K   F   K   H   I   K   L   I   S   L   F   T   R   V   S   E   G
```

```
cttctcaacaccgacatggaaagtaacggcaccggaaacgccgtcaacacttcgtcgatt
 L  L  N  T  D  M  E  S  N  G  T  G  N  A  V  N  T  S  S  I ttcacttgggtccttcgcaatcccgagacctcggcaggcttctacgttacgcaacacgac
 F  T  W  V  L  R  N  P  E  T  S  A  G  F  Y  V  T  Q  H  D aactccaggtctcgcgagaacacccctttctctttgaacctcgccacgtccgagggcgca
 N  S  R  S  R  E  N  T  P  F  S  L  N  L  A  T  S  E  G  A gttactgtaccgagtcttgatttgcgcggccgtcaaagcaggatagtggttaccgattac
 V  T  V  P  S  L  D  L  R  G  R  Q  S  R  I  V  V  T  D  Y cctgtcggggattacacacttttgtactcatctgccgaggtcttgacctacggagtgttt
 P  V  G  D  Y  T  L  L  Y  S  S  A  E  V  L  T  Y  G  V  F gacgtgcctgttatcgtcttctacctcaacagaggccaagtgggagagcttgccttcaag
 D  V  P  V  I  V  F  Y  L  N  R  G  Q  V  G  E  L  A  F  K ggaggcctcaagaacacaaacttcaccacctacggcgctgagacggacttcactgccacc
 G  G  L  K  N  T  N  F  T  T  Y  G  A  E  T  D  F  T  A  T gccgccggcaacgacacgtccgcagccttcaagtacactcagtccgagggcgccaccgtc
 A  A  G  N  D  T  S  A  A  F  K  Y  T  Q  S  E  G  A  T  V atcaaattcgccaacggaccggtgctataccctcctcgaaagatgggccgcatacacctc
 I  K  F  A  N  G  P  V  L  Y  L  L  E  R  W  A  A  Y  T  F ttcgcgccagccatgacctcgaacccgcacatcgccgccgacgagcagatcttcgtgctt
 F  A  P  A  M  T  S  N  P  H  I  A  A  D  E  Q  I  F  V  L gggccctacctcgtccgcagcgccagcgtcaccggcagcaccgtctccatatcgggcgac
 G  P  Y  L  V  R  S  A  S  V  T  G  S  T  V  S  I  S  G  D cacctcaacgacaccagcatcgacgtctacgtcggcgacccctccgtcaccagcatcagc
 H  L  N  D  T  S  I  D  V  Y  V  G  D  P  S  V  T  S  I  S tggaacggcgccgcgctcgcgacgacgcgtctgcctacggctcgctgcaggcttcgctg
 W  N  G  A  A  L  A  T  T  R  S  A  Y  G  S  L  Q  A  S  L ccgggcatcctcgaccgcgtcgtcgcgctgcccgctctgacgggctggagggtcgccgac
 P  G  I  L  D  R  V  V  A  L  P  A  L  T  G  W  R  V  A  D gccctgcctgaggccgaccggcctatgacgactcgcgctggaccgtcgccaacaagaca
 A  L  P  E  A  D  P  A  Y  D  D  S  R  W  T  V  A  N  K  T accaccctcagcccgctcgcgccgctcacgctgcccgtgctgtacggcgccgactacggc
 T  T  L  S  P  L  A  P  L  T  L  P  V  L  Y  G  A  D  Y  G ttctacgccggcgtcctgctgtaccgcggccactttgctggagctggcgcgactggcgcg
 F  Y  A  G  V  L  L  Y  R  G  H  F  A  G  A  G  A  T  G  A aacgtcaccgtgcaaggcggcgtcgcggcggggtggtcggcatggctgaatggcaagctg
 N  V  T  V  Q  G  G  V  A  A  G  W  S  A  W  L  N  G  K  L gtcggcggccaccccggcaacgcgtcgctgctccagacgtccgtcgtgctggacttcgcc
 V  G  G  H  P  G  N  A  S  L  L  Q  T  S  V  V  L  D  F  A ggcgccgagctgagagaggagggaaatgttttgactgtggtgacggactatactgggcac
 G  A  E  L  R  E  E  G  N  V  L  T  V  V  T  D  Y  T  G  H gaccaggacagccagggaccctacggcccgctaaaccccggggcatcctgggcgcgaag
 D  Q  D  S  Q  G  P  Y  G  P  L  N  P  R  G  I  L  G  A  K ctgatcggcacgagcaacgccacgaattcgagtgcgccggtgttcgagcagtggaagatt
 L  I  G  T  S  N  A  T  N  S  S  A  P  V  F  E  Q  W  K  I cagggaatgcgggaggtggcgcgggatatatcgatccggtgcgtgggccgatgaatgag
 Q  G  N  A  G  G  G  A  G  Y  I  D  P  V  R  G  P  M  N  E ggtggactgcatggcgagcggttgggatggcatttgcctgggttcgataccgcgcagtgg
 G  G  L  H  G  E  R  L  G  W  H  L  P  G  F  D  T  A  Q  W gaggagggcgatccactcgaggggttcaagggcgcaggcatcaaatggtacaggacggag
 E  E  G  D  P  L  E  G  F  K  G  A  G  I  K  W  Y  R  T  E tttgacctcgatgtggacgaggacctggatgcgccgattgggctggaagtgagcattccg
 F  D  L  D  V  D  E  D  L  D  A  P  I  G  L  E  V  S  I  P gatgggacagtggcgagggtgcagatcttcatcaatggttaccagtatggcaagtatctg
 D  G  T  V  A  R  V  Q  I  F  I  N  G  Y  Q  Y  G  K  Y  L
```

```
                         -continued
ccgcatattggcccgcagacgaagtttcccttcccgcccggtgtgctgaacaaccgcgga
  P  H  I  G  P  Q  T  K  F  P  F  P  P  G  V  L  N  N  R  G acgaatagtctgtcactcagtgtttgggcgcagacgaagagggtgtcgcgttcgataag
  T  N  S  L  S  L  S  V  W  A  Q  T  E  E  G  V  A  F  D  K gtggatctcgtcttgtacgggaagtaccagtccgactttgggttttcgagggattggagc
  V  D  L  V  L  Y  G  K  Y  Q  S  D  F  G  F  S  R  D  W  S gcgctccagccgggctggtcggaggagcgcctgcagtatgcgtag
  A  L  Q  P  G  W  S  E  E  R  L  Q  Y  A  -
```

SEQ ID NO: 351
LENGTH: 994
TYPE: PRT
ORGANISM: M. phaseolina
MRALTALLLLLGAVTSLVCAQRDNGYSDVVQWDENSLFINGERVYIYSGEFHYARLPVPELWRDIIQKYKANG

LNTLSIYFFWSYHSPSKGVFDFESPGKDIQKLFDIAKEEGVYIIARPGPYCNAETSAGGYGLYLTDGSGGDVR

TNDETYHEQWLPWINAVLPIIARNQITEGGPVILVQVENELTQSRHVATDPLVLYMEQLKKAFRDNGIVVPFT

SNEKGMRGQSWSTDYQNVGGAVDIYGLDSYAGGLSCSNIDTGFTIVRTYYQWFQNYSYTQPEFTPEFKGGWFQ

PWGGYFFDDCISEHDTAYPDVFYKNNIAQRLTLQNMYMTYGGTNWGHLAAPVVYTSYDYGAPLRETREIWDKF

KHIKLISLFTRVSEGLLNTDMESNGTGNAVNTSSIFTWVLRNPETSAGFYVTQHDNSRSRENTPFSLNLATSE

GAVTVPSLDLRGRQSRIVVTDYPVGDYTLLYSSAEVLTYGVFDVPVIVFYLNRGQVGELAFKGGLKNTNFTTY

GAETDFTATAAGNDTSAAFKYTQSEGATVIKFANGPVLYLLERWAAYTFFAPAMTSNPHIAADEQIFVLGPYL

VRSASVTGSTVSISGDHLNDTSIDVYVGDPSVTSISWNGAALATTRSAYGSLQASLPGILDRVVALPALTGWR

VADALPEADPAYDDSRWTVANKTTTLSPLAPLTLPVLYGADYGFYAGVLLYRGHFAGAGATGANVTVQGGVAA

GWSAWLNGKLVGGHPGNASLLQTSVVLDFAGAELREEGNVLTVVTDYTGHDQDSQGPYGPLNPRGILGAKLIG

TSNATNSSAPVFEQWKIQGNAGGGAGYIDPVRGPMNEGGLHGERLGWHLPGFDTAQWEEGDPLEGFKGAGIKW

YRTEFDLDVDEDLDAPIGLEVSIPDGTVARVQIFINGYQYGKYLPHIGPQTKFPFPPGVLNNRGTNSLSLSVW

AQTEEGVAFDKVDLVLYGKYQSDFGFSRDWSALQPGWSEERLQYA*

SEQ ID NO: 352
LENGTH: 1590 (including 150 bp 5' UTR and 150 bp 3' UTR)
TYPE: DNA
ORGANISM: M. phaseolina
TCTCCCTGATTTGCTAACGCTCTTTTCCTCTATACACAGCGAGACCTTCTGCGTAAAGTCCGGTCCGCTTCGC

GATTGCTGTTGTGCTACCTCCACTCTCTTTCCCAACCTCGCGAAATTTTACTTTACAGCCTGGACTAAGCGGC

GAAGATGCTGTCGAAGAACCTTATCAGCTCGATATCCTTGCTGGCATCCACGATCCATGGTGTTGCCGCCCTT

TCCAAGGGCCATGATCTGTCGTCCGCTGGGTATATGGAGACGGATCAGGGCGCTACCTGGCTTTCCGAGTCTG

GTTCTGCTAGCACAATTGAGGAGATCCTTGGAGCTGGTGGTATGGACAGCGTCAGGCTAAGGTGAGTTCCTTG

CATCGCTCTCTTCGCACATTTTACTCCAAGACGACGGCCACGCACAAGCAATAGGAGCGTATCCTCATGTATG

ATCTCATGCCATGGTGTATCTTCCTGCTTGCACGCGAGAAGGGCGTTTGTTATCTTGGACAATGGACCCCTTT

GCTCCTTCTACTCAACCAGGCATGCACTCATCACAAAGCAAGGACTGATTGACGTGTGTTCAAGACTCTGGAC

CGGAGATGCCTACGGCCTCGACTACACTCTTGACCTTGCGAAGCGCTTTTCCAGCGCCGGCTACAAGATCTAC

CTGGACTTGCACCTCAGCGACACCTGGGCAGACCCGTCGAACCAAGCCACCCCAGCCTCCTTCGACACCTCCG

ACCTCGCCGGCTCTGTGCGCTCCTACGTCAAATCGACGCTCCAGTCCTTCTCAGACGGTGGCGTCACGCTTGA

CATCCTGTCGATCGGCAACGAGATCATCAAGGGCATGCTGTTCCCCTCGGGCGAGATCTCGAACAACGACTTC

TCGGGCTTCGCGAAGCTGTGGCGGCGGCGCGTGCGGGCGTCGACGATGCCGTCGCCGCGGGCGTGACCAAGC

CGCAGGTCATGATTCACCTGAACAACGGGTGGGACGAAGCTACCATGACGTGGTGGTTCAAGGGCTTGTTCGA

TGAAGGCACCGTCACCCAGGACATGGTCGACGTCTTCGGCTTCTCCTTCTACCCCTTCTTCGACATAAAGGCC

ACCACTTCCGCGCTGCAGAACAGCTTCAACACCCTGGCAAGCACGTACAACAAGCCGCTGTACGTCGCTGAGA

CGGACTGGCCGACGAGCTGCTCGGACGTCGATCTTTCTGCCGATTTCGCGGTTTCGGCTCAGGGCCAGAGCGA

```
                                -continued
TTGGGTGGGTGCGGTGGTGGATGTGTTGAACAATGTGCCTGATGGATTGGGTGCGGGTATCTTCTACTGGGAG

CCAGGCTTCATCAATAACACGGCGCTGGGAAGTGACTGCGATGACAACATCCTGTTCGACGTCAGCTGGACA

ACTGGCCGAAGACCAGCGCCACGGCGAGATCGTCGGTGAACATGTTTGCATAGATATGGCGGACTGCCCTCAT

CTCCACTTCCCGAGAAATATGAAGGCATGTCGTATGGACTCAGTTTCTTGAAGCGGTGGTTGTTGAGATCTGA

ATTTTACCAAGAACCTCGGAgGGGGGGGAAACAGCTGTTATTAAGCTCGCAGTCGACT

SEQ ID NO: 353
LENGTH: 1068
TYPE: DNA
ORGANISM: M. phaseolina
FEATURE NAME/KEY: CDS
LOCATION: (1)...(1068)
atgctgtcgaagaaccttatcagctcgatatccttgctggcatccacgatccatggtgtt
 M   L   S   K   N   L   I   S   S   I   S   L   L   A   S   T   I   H   G   V gccgccctttccaagggccatgatctgtcgtccgctgggtatatggagacggatcagggc
 A   A   L   S   K   G   H   D   L   S   S   A   G   Y   M   E   T   D   Q   G gctacctggctttccgagtctggttctgctagcacaattgaggagatccttggagctggt
 A   T   W   L   S   E   S   G   S   A   S   T   I   E   E   I   L   G   A   G ggtatggacagcgtcaggctaagactctggaccggagatgcctacggcctcgactacact
 G   M   D   S   V   R   L   R   L   W   T   G   D   A   Y   G   L   D   Y   T ctttgaccttgcgaagcgcttttccagcgccggctacaagatctacctggacttgcacctc
 L   D   L   A   K   R   F   S   S   A   G   Y   K   I   Y   L   D   L   H   L agcgacacctgggcagacccgtcgaaccaagccaccccagcctccttcgacacctccgac
 S   D   T   W   A   D   P   S   N   Q   A   T   P   A   S   F   D   T   S   D ctcgccggctctgtgcgctcctacgtcaaatcgacgctccagtccttctcagacggtggc
 L   A   G   S   V   R   S   Y   V   K   S   T   L   Q   S   F   S   D   G   G gtcacgcttgacatcctgtcgatcggcaacgagatcatcaagggcatgctgttcccctcg
 V   T   L   D   I   L   S   I   G   N   E   I   I   K   G   M   L   F   P   S ggcgagatctcgaacaacgacttctcgggcttcgcgaagctgtgggcggcggcgcgtgcg
 G   E   I   S   N   N   D   F   S   G   F   A   K   L   W   A   A   A   R   A ggcgtcgacgatgccgtcgccgcgggcgtgaccaagccgcaggtcatgattcacctgaac
 G   V   D   D   A   V   A   A   G   V   T   K   P   Q   V   M   I   H   L   N aacgggtgggacgaagctaccatgacgtggtggttcaagggcttgttcgatgaaggcacc
 N   G   W   D   E   A   T   M   T   W   W   F   K   G   L   F   D   E   G   T gtcacccaggacatggtcgacgtcttcggcttctccttctaccccttcttcgacataaag
 V   T   Q   D   M   V   D   V   F   G   F   S   F   Y   P   F   F   D   I   K gccaccacttccgcgctgcagaacagcttcaacaccctggcaagcacgtacaacaagccg
 A   T   T   S   A   L   Q   N   S   F   N   T   L   A   S   T   Y   N   K   P ctgtacgtcgctgagacggactggccgacgagctgctcggacgtcgatctttctgccgat
 L   Y   V   A   E   T   D   W   P   T   S   C   S   D   V   D   L   S   A   D ttcgcggtttcggctcagggccagagcgattgggtgggtgcggtggtggatgtgttgaac
 F   A   V   S   A   Q   G   Q   S   D   W   V   G   A   V   V   D   V   L   N aatgtgcctgatggattgggtgcgggtatcttctactgggagccaggcttcatcaataac
 N   V   P   D   G   L   G   A   G   I   F   Y   W   E   P   G   F   I   N   N acggcgctgggaagtgactgcgatgacaacatcctgttcgacgtcagctgggacaactgg
 T   A   L   G   S   D   C   D   D   N   I   L   F   D   V   S   W   D   N   W ccgaagaccagcgccacggcgagatcgtcggtgaacatgtttgcatag
 P   K   T   S   A   T   A   R   S   S   V   N   M   F   A   -

SEQ ID NO: 354
LENGTH: 355
TYPE: PRT
ORGANISM: M. phaseolina
MLSKNLISSISLLASTIHGVAALSKGHDLSSAGYMETDQGATWLSESGSASTIEEILGAGGMDSVRLRLWTGD

AYGLDYTLDLAKRFSSAGYKIYLDLHLSDTWADPSNQATPASFDTSDLAGSVRSYVKSTLQSFSDGGVTLDIL

SIGNEIIKGMLFFSGEISNNDFSGFAKLWAAARAGVDDAVAAGVTKPQVMIHLNNGWDEATMTWWFKGLFDEG
```

-continued

TVTQDMVDVFGFSFYPFFDIKATTSALQNSFNTLASTYNKPLYVAETDWPTSCSDVDLSADFAVSAQGQSDWV

GAVVDVLNNVPDGLGAGIFYWEPGFINNTALGSDCDDNILFDVSWDNWPKTSATARSSVNMFA*

SEQ ID NO: 355
LENGTH: 1417 (including 150 bp 5' UTR and 150 bp 3' UTR)
TYPE: DNA
Organism: M. phaseolina
AAAGTTGAAACGGCCTTTTGCCAAACGAGTGAATACGAGCATTTGAGATACTGACGATTCCGGTTCTTCCGCA

ATGCTAATACACATCGCTCTGTTTCCCTCTTTGCTGCCGTTGCTCATCACTCCATTCGTTCCTTGGTGTTAGC

CAACATGTTCTCCACGATGGCAACCTGGCTCTCTCTGCTCCTGGTGCCATGCGCCGTTTTGGGAGACACCATC

GCCTACAAAGGCGCTGACATTTCATCCCTGTTAATGCTTGAAGCAAAGGGCCAAACCTACAAGACCACAGGCG

GCGTAACAACGCCGCTGGAGAAGATACTTGCTTCCTCTGGCGTCAACTCTGTCCGCCAAAGGGTCTGGGTCAA

TCCGTCAGATGGCAACTACAATCTTGACTACAACCTGAAGTTGTCAAAGCGGGTCAAAGCCGCCGGCATGAGT

ATTTACCTGGACCTGCATCTCAGTGACACTTGGGCAGACCCGTCGCATCAGGTAAGGCAACTGGCAAAGCTTC

ATATGCATACATATTGACTTGACTTGTCAGACCACACCCGCTGCCTGGGATGACTCCACCATTGGCACGCTGA

CCAACACGGTCTATGAATATACCAAATCCGTCTCCAACTCGTACGCCAGTGCCGGCATCACACCGAGCATCAT

CTCAATTGGCAATGAGATCCGCGCTGGTTTGCTGTGGCCCCTGGGAGGCACTTCATCCTACTACAATATCGCC

TCGCTCCTCCACTCTGCCGCATGGGGCATCAAGGACAGCAACCTCTCGCCCAAACCGAAGATTATGATCCACC

TGGACAATGGCTGGGACTCCGGTACGCAGGTCTGGTGGTACAACGAGGTGCTCGGCCAGGGACCTCTCCTGAA

GACAGACTTCGATATGATCGGCGTTTCATACTACCCCTTCTACAATAAGGAGGCGTACTTGGGCTCCCTCAAG

TACTCTCTGCAGCAGCTCGCCTCCAAATTTGGCAAGCAGCTCGTCGTAGCCGAGACGAACTGGCCCGCCAGCT

GCCCAAACCCTGCTTACGCGTTCCCCAGCGATACCAGTTCTATTCCCAAGAGCGCTGCGGGCCAGGCTACTTG

GATCAAGGACGTGGCAAATATCGTCAAGGGTGTGAGCGGTGGTGTCGGTATCTACTACTGGGAGCCGGCCTGG

ATCGGCAATGGTGCGCTGGGATCAAGCTGCGCTGACAACCTTCTCGTTGATAGCTCCGGCAAGGCGAGAGAGG

GTATCGCGGCCCTGGGATCGGTGTAAGCACGGAATGTACCATCGTAATGAGAAGGCGTTCCGGGCGTTGTCCG

CCGGTCCTTTCGATCTCCATTCCCGATCCTTCTTTTATTTGGGACCCTCAACGTACATATTACCTTCTCAAGA

GATTGAGGCTTCGAGCCACGTTTGTCCCCA

SEQ ID NO: 356
LENGTH: 1065
TYPE: DNA
ORGANISM: M. phaseolina
FEATURE NAME/KEY: CDS
LOCATION: (1)...(1065)
atgttctccacgatggcaacctggctctctctgctcctggtgccatgcgccgttttggga
 M   F   S   T   M   A   T   W   L   S   L   L   L   V   P   C   A   V   L   G gacaccatcgcctacaaaggcgctgacatttcatccctgttaatgcttgaagcaaagggc
 D   T   I   A   Y   K   G   A   D   I   S   S   L   L   M   L   E   A   K   G caaacctacaagaccacaggcggcgtaacaacgccgctggagaagatacttgcttcctct
 Q   T   Y   K   T   T   G   G   V   T   T   P   L   E   K   I   L   A   S   S ggcgtcaactctgtccgccaaagggtctgggtcaatccgtcagatggcaactacaatctt
 G   V   N   S   V   R   Q   R   V   W   V   N   P   S   D   G   N   Y   N   L gactacaacctgaagttgtcaaagcgggtcaaagccgccggcatgagtatttacctggac
 D   Y   N   L   K   L   S   K   R   V   K   A   A   G   M   S   I   Y   L   D ctgcatctcagtgacacttgggcagacccgtcgcatcagaccacaccgctgcctgggat
 L   H   L   S   D   T   W   A   D   P   S   H   Q   T   T   P   A   A   W   D gactccaccattggcacgctgaccaacacggtctatgaatataccaaatccgtctccaac
 D   S   T   I   G   T   L   T   N   T   V   Y   E   Y   T   K   S   V   S   N tcgtacgccagtgccggcatcacaccgagcatcatctcaattggcaatgagatccgcgct
 S   Y   A   S   A   G   I   T   P   S   I   I   S   I   G   N   E   I   R   A ggtttgctgtggcccctgggaggcacttcatcctactacaatatcgcctcgctcctccac
 G   L   L   W   P   L   G   G   T   S   S   Y   Y   N   I   A   S   L   L   H

```
tctgccgcatggggcatcaaggacagcaacctctcgcccaaaccgaagattatgatccac
 S   A   A   W   G   I   K   D   S   N   L   S   P   K   P   K   I   M   I   H ctggacaatggctgggactccggtacgcaggtctggtggtacaacgaggtgctcggccag
 L   D   N   G   W   D   S   G   T   Q   V   W   W   Y   N   E   V   L   G   Q ggacctctcctgaagacagacttcgatatgatcggcgtttcatactacccttctacaat
 G   P   L   L   K   T   D   F   D   M   I   G   V   S   Y   Y   P   F   Y   N aaggaggcgtacttgggctccctcaagtactctctgcagcagctcgcctccaaatttggc
 K   E   A   Y   L   G   S   L   K   Y   S   L   Q   Q   L   A   S   K   F   G aagcagctcgtcgtagccgagacgaactggcccgccagctgcccaaaccctgcttacgcg
 K   Q   L   V   V   A   E   T   N   W   P   A   S   C   P   N   P   A   Y   A ttccccagcgataccagttctattcccaagagcgctgcgggccaggctacttggatcaag
 F   P   S   D   T   S   S   I   P   K   S   A   A   G   Q   A   T   W   I   K gacgtggcaaatatcgtcaagggtgtgagcggtggtgtcggtatctactactgggagccg
 D   V   A   N   I   V   K   G   V   S   G   G   V   G   I   Y   Y   W   E   P gcctggatcggcaatggtgcgctgggatcaagctgcgctgacaaccttctcgttgatagc
 A   W   I   G   N   G   A   L   G   S   S   C   A   D   N   L   L   V   D   S tccggcaaggcgagagagggtatcgcggccctgggatcggtgtaa
 S   G   K   A   R   E   G   I   A   A   L   G   S   V   -

SEQ ID NO: 357
LENGTH: 354
TYPE: PRT
ORGANISM: M. phaseolina
MFSTMATWLSLLLVPCAVLGDTIAYKGADISSLLMLEAKGQTYKTTGGVTTPLEKILASSGVNSVRQRVWVNP

SDGNYNLDYNLKLSKRVKAAGMSIYLDLHLSDTWADPSHQTTPAAWDDSTIGTLTNTVYEYTKSVSNSYASAG

ITPSIISIGNEIRAGLLWPLGGTSSYYNIASLLHSAAWGIKDSNLSPKPKIMIHLDNGWDSGTQVWWYNEVLG

QGPLLKTDFDMIGVSYYPFYNKEAYLGSLKYSLQQLASKFGKQLVVAETNWPASCPNPAYAFPSDTSSIPKSA

AGQATWIKDVANIVKGVSGGVGIYYWEPAWIGNGALGSSCADNLLVDSSGKAREGIAALGSV*

SEQ ID NO: 358
LENGTH: 1497 (including 150 bp 5' UTR and 150 bp 3' UTR)
TYPE: DNA
ORGANISM: M. phaseolina
TTTTTGCCTTTGCAACCACGATGCCTATTGGAGGAATATCTTTGCAAGACTCAGTCTCCTCGCCCGCCCGCAC

GCGAGCTCTCTATAAGAAGAGTCACCAGCTCGCTTCTTGCCAACACTGCCCCGCTGTCAGGACTTATCTTCTT

CACCATGTTCATCACCAAGCTTGTCGCTGTGGGCTCAGTCCTGTTATGCGGAGCAGCCGCCGCTCCCAAGCCC

GCTCCTGTCTTCTACAAGGGGCATGACTTGTCCACGCTCAAGATCATGGAGGAGAGCCAGGTGGTCTACATTG

ACACTGCGAGAAACAACGCAACTCGGCCGGCGGATGATATCCTTGGTGATGGGGCATGAACACAGTGCGATT

GAGGTTGGTCCCCACTCCGCAACCGTCCCAATAGTGATGACTGACCAGCAACAGGCTCTGGGTGAACCCTATC

CCCGGCCAGTATGACCTTCCCTACATCCTCAGCTTAGCAAAGCGCTTCGCCAACAAGGGCTATCACATCTACC

TCGACTACCATTTCTCCGACACCTGGGCCGACCCGCAGCACAACAACGCCCCGGTTGCCTGGCCCACCACCCT

GCCCGAGGTGGCCAAAACCATCCGCGGCTACGTCAACGAGACCCTGCACGCCTTCAAGGACGAGGGCATCGAC

CTCTCCATCGTCAGTCTGGGCAACGAGGTCCGCCACGGCATGGTCTGGCCGCTGGGCTACGTCGATGTCGACA

CTCCTGGCGATAAGGCCCGCGCCCAGAACTTCACCGGCCTGGCCACCATCTACGAGAGCGCCCGCCGCGGCGT

CGACGACGCCGTTGCCGGCGGCGTGCACAAGCCCGAGATCATGATCCACGTCGACAACGGCTGGAACCTGACC

CTCCAAGAGGCCTGGTTCAGCGCCCTCACCGACACCGGCATCGTCAAGACCTCCGATTGGGACGTCTTCGGCT

TCTCCTTCTACCCCTTCTACGGCACCGCCGCCACCTTTAAGAACTTGAAGAAGACGCTCAATACCATCTCCCG

CAAGTACAAGAAGCCCGTCCAGGTCGTCGAGACGGATTATCCTGTTCTCTGCTCCGGCCAGTGGGGACCCGTT

CCCGACCTCAGCGAGCCCTCCATCCCCGTCAGCGTCGAAGGCCAGATTGAGTGGGTCCACGAGGTTATTGATA

TCGTGAGACAGGTGCCGCAGGGGAGGGGAACGGGCGTGCATTACTGGGACCGGCCTGGACCAATTTGACGAG

CTTGGGGAGCGCCTGCGATGACGCTATTCTGTTCCAGGCGGATTACAGCACATGGCCGGTGACGACGGCGTAT
```

```
TCTAGGAAGTCGGTGAACCTGTTTAATTACTAATGTAATGAGAAGATATCAAGCGCAAGGCTTAGACCTGCTA

GTAGTAAGAAAAATTTAGCCTCCATGACAACAATAGACGTCTCCTCGCCCAAGGCGTCCCTTTTTTTTCGCAG

GTGGGGTATTGGCCCCTTTTATGGCGGTCAATGCGAG

SEQ ID NO: 359
LENGTH: 1146
TYPE: DNA
ORGANISM: M. phaseolina
FEATURE NAME/KEY: CDS
LOCATION: (1)...(1146)
atgttcatcaccaagcttgtcgctgtgggctcagtcctgttatgcggagcagccgccgct
 M  F  I  T  K  L  V  A  V  G  S  V  L  L  C  G  A  A  A  A cccaagcccgctcctgtcttctacaaggggcatgacttgtccacgctcaagatcatggag
 P  K  P  A  P  V  F  Y  K  G  H  D  L  S  T  L  K  I  M  E gagagccaggtggtctacattgacactgcgagaaacaacgcaactcggccggcggatgat
 E  S  Q  V  V  Y  I  D  T  A  R  N  N  A  T  R  P  A  D  D atccttggtgatggggcatgaacacagtgcgattgaggctctgggtgaacccatcccc
 I  L  G  D  G  G  M  N  T  V  R  L  R  L  W  V  N  P  I  P ggccagtatgaccttccctacatcctcagcttagcaaagcgcttcgccaacaagggctat
 G  Q  Y  D  L  P  Y  I  L  S  L  A  K  R  F  A  N  K  G  Y cacatctacctcgactaccatttctccgacacctgggccgacccgcagcacaacaacgcc
 H  I  Y  L  D  Y  H  F  S  D  T  W  A  D  P  Q  H  N  N  A ccggttgcctggcccaccaccctgccgaggtggccaaaaccatccgcggctacgtcaac
 P  V  A  W  P  T  T  L  P  E  V  A  K  T  I  R  G  Y  V  N gagaccctgcacgccttcaaggacgagggcatcgacctctccatcgtcagtctgggcaac
 E  T  L  H  A  F  K  D  E  G  I  D  L  S  I  V  S  L  G  N gaggtccgccacggcatggtctggccgctgggctacgtcgatgtcgacactcctggcgat
 E  V  R  H  G  M  V  W  P  L  G  Y  V  D  V  D  T  P  G  D aaggcccgcgcccagaacttcaccggcctggccaccatctacgagagcgcccgccgcggc
 K  A  R  A  Q  N  F  T  G  L  A  T  I  Y  E  S  A  R  R  G gtcgacgacgccgttgccggcggcgtgcacaagcccgagatcatgatccacgtcgacaac
 V  D  D  A  V  A  G  G  V  H  K  P  E  I  M  I  H  V  D  N ggctggaacctgaccctccaagaggcctggttcagcgccctcaccgacaccggcatcgtc
 G  W  N  L  T  L  Q  E  A  W  F  S  A  L  T  D  T  G  I  V aagacctccgattgggacgtcttcggcttctccttctaccccttctacggcaccgccgcc
 K  T  S  D  W  D  V  F  G  F  S  F  Y  P  F  Y  G  T  A  A acctttaagaacttgaagaagacgctcaataccatctcccgcaagtacaagaagcccgtc
 T  F  K  N  L  K  K  T  L  N  T  I  S  R  K  Y  K  K  P  V caggtcgtcgagacggattatcctgttctctgctccggccagtggggacccgttccgac
 Q  V  V  E  T  D  Y  P  V  L  C  S  G  Q  W  G  P  V  P  D ctcagcgagccctccatccccgtcagcgtcgaaggccagattgagtgggtccacgaggtt
 L  S  E  P  S  I  P  V  S  V  E  G  Q  I  E  W  V  H  E  V attgatatcgtgagacaggtgccgcaggggaggggaacgggcgtgcattactgggagccg
 I  D  I  V  R  Q  V  P  Q  G  R  G  T  G  V  H  Y  W  E  P gcctggaccaatttgacgagcttggggagcgcctgcgatgacgctattctgttccaggcg
 A  W  T  N  L  T  S  L  G  S  A  C  D  D  A  I  L  F  Q  A gattacagcacatggccggtgacgacggcgtattctaggaagtcggtgaacctgtttaat
 D  Y  S  T  W  P  V  T  T  A  Y  S  R  K  S  V  N  L  F  N tactaa
 Y  -
SEQ ID NO: 360
LENGTH: 381
TYPE: PRT
ORGANISM: M. phaseolina
MFITKLVAVGSVLLCGAAAAPKPAPVFYKGHDLSTLKIMEESQVVYIDTARNNATRPADDILGDGGMNTVRLR

LWVNPIPGQYDLPYILSLAKRFANKGYHIYLDYHFSDTWADPQHNNAPVAWPTTLPEVAKTIRGYVNETLHAF

KDEGIDLSIVSLGNEVRHGMVWPLGYVDVDTPGDKARAQNFTGLATIYESARRGVDDAVAGGVHKPEIMIHVD
```

```
NGWNLTLQEAWFSALTDTGIVKTSDWDVFGFSFYPFYGTAATFKNLKKTLNTISRKYKKPVQVVETDYPVLCS

GQWGPVPDLSEPSIPVSVEGQIEWVHEVIDIVRQVPQGRGTVHYWEPAWTNLTSLGSACDDAILFQADYSTW

PVTTAYSRKSVNLFNY*

SEQ ID NO: 361
LENGTH: 2112 (including 150 bp 5' UTR and 150 bp 3' UTR)
TYPE: DNA
ORGANISM: M. phaseolina
AAACCACAATTAAGCTTCTCGGATAGAATCAGGGCCAGGGCGTCAATTCCCCATCTGCTCCCGTTGCTTCCCT

ACATATATACCTTTCTCCTCTCTCTACTCTCCTCTTCATTCTCAAAGTGTCCCATCCGTTGCCCCCTTCCAGC

AAAGATGTCTACATTTTCTACCCTCCCGTCCACCCTCGTCCTCCTCCTTTCCCTTCTTCCACTCCTCACGTGC

GCCTGGCTACCCACCAGTTGCCCGCCTGGCATCTCCCTCTCAGCCTTTCGCACAAGTCCTACCAATAAAATCC

GTGGCGTCAACCTCGGCTCGCAGTTCATCATCGAGCCGTGGATGGCGCGCCACGAGTGGGCCGCAATGGGCTG

CGGCGACGCTGAGGCCGAGTTCCAGTGCATCAAGAACCAGTACGGCGGCGACATCGCGCGGGCCAGCCAGGTG

TGGAAGAAGCACTGGGCCACGTGGATCAACGGGACGGACCTGGACCAGATGGTGCAGATGGGGTTGAACACGA

TCAGGGTCAGTTCTCCGTTCGGTCCCGTCTTTTGCTCTAGGAATTCCCCGATTGAGAGTTCTTCGGAATGAAA

TAAGGTTGTGATGTCGTGCAGGGGTTATGGCGGGGCGGATGGTCCCGGGACGAAATGCTGGCCTTTGCTGAT

GCTCGGGTTTTTGGTGGGGTGATAGGTTCCGGTTGGTTGGTGGATGAAGGAGGATCTGGTGAGGAGTGGGGAG

TACTTCCCCAAAGGCGGGTTCGCGTACCTGCAGAGCTTGTGCGAGCATGCTGCAAGTAATGGCATGTATGTCA

TTATCGGTCAGTGCCCGGATTGCCACCAATTGGCTTTTACATTTGACTTCGTTCCATTCTAACCGAGAAGCCT

GTGGTGTCAGAAATGCACGGGCCCCCGGCACCCAGAATGCTCAGCAGCCGTTCACGGGAAATGTAATTGCTC

TCAAACGAGCGGCCTCAACCGCAACCATATAGAGCATACTGACCAGAATCCTTCCCTCACCCAGTACTCTGAC

GCCACCTACTTCTACCAATCCGACTACCAATCCGCCCGCGCCTACGTTCGTACCGTCCCCTACCCTCCACACA

CGCCCACTAACCTCCCCTCTGCAGGACTTCCTCGTCTTCCTCACCCACGCCATCCACACGCACCCCTCCTTCC

GCACCGTCGGCGCCCTCGGCCTCCTCAACGAGCCCGTCTTCAACAATCCTCTCTCCGCCAACAGCCAGTGGAC

CGTCTCGCACTTCTACCCCTCCGCCATCGCCGCCATCCGCGCCGCCGAAGCTGCGCTCGGCGTGCGCCCTCCC

GCCGCCCTCACCCTCACCGTCATGGACGACCTCTGGCTCGACCTGTCCGGCCAGTCTGACCCGGCCGCGCACC

TGACAGATGCGCAGCGGCGAGGCGTGCTGTGGGACGAGCACAACTACCAAAGCTCGCCCGTCGCGAATATGAA

GCCCGAGGAGGTGGTCGCCTATGCGTGTGGGGATGATCGAAGGACGGGgCGGCAGCCGGGGGAAGTAAAGTTT

GTGGGGGAGTGGTCGATGGCGGTGCAGCAGTGAGTAGTGTGAATACCGTTTTGGTGTGCTTTTTGAAGGGGAG

GGGCTGATGAATCGTGCGTTTTTCTCCCTTTAGGAAGGGCGAAGGCTTCACGCCCGAGACGGACTACAAGGCG

TTTTGGAACCAATACTTCGCGGCGCTGCAGTGGAATTATGAGAGGACCAGGGGCTGGGTGTGGTGGACGTGGA

AGGCTGAGGGGGGGGCGAGGCTGCAGAATTGGCTGCAGTGGAGTTATAAGGGTGAGTTTGTCTTTCTTCGCCT

TTTTCCTATTTGCGGACGTTGAAGCAGAAGGAAGTGGTGATGTGCTGCTAACAGTTACGTCAGGCTTAGTCGA

GAATGGGATTGTGAGTAAAGATTTGAATTCGCAATTGGCCTTGAATCCTTGCACTGGACACTGATGCAGGCGC

GGTGCAATTATGTTGGTGGTTGAAGTCAGCCATCGAGAACCTACTTTAGTAAATAGATAGACAAGAAACGGCC

GGCTTCCATAGTGCAGAATTGAGGTACTCTGATTCTTATGGGCTATGCTTTGATGGTATTGTACGGTA

SEQ ID NO: 362
LENGTH: 1281
TYPE: DNA
ORGANISM: M. phaseolina
FEATURE NAME/KEY: CDS
LOCATION: (1)...(1281)
atgtctacattttctaccctcccgtccaccctcgtcctcctcctttcccttcttccactc
  M   S   T   F   S   T   L   P   S   T   L   V   L   L   L   S   L   L   P   L ctcacgtgcgcctggctacccaccagttgcccgcctggcatctccctctcagcctttcgc
  L   T   C   A   W   L   P   T   S   C   P   P   G   I   S   L   S   A   F   R
```

-continued

```
acaagtcctaccaataaaatccgtggcgtcaacctcggctcgcagttcatcatcgagccg
  T  S  P  T  N  K  I  R  G  V  N  L  G  S  Q  F  I  I  E  P tggatggcgcgccacgagtgggccgcaatgggctgcggcgacgctgaggccgagttccag
  W  M  A  R  H  E  W  A  A  M  G  C  G  D  A  E  A  E  F  Q tgcatcaagaaccagtacggcggcgacatcgcgcgggccagccaggtgtggaagaagcac
  C  I  K  N  Q  Y  G  G  D  I  A  R  A  S  Q  V  W  K  K  H tgggccacgtggatcaacgggacggacctggaccagatggtgcagatggggttgaacacg
  W  A  T  W  I  N  G  T  D  L  D  Q  M  V  Q  M  G  L  N  T atcagggttccggttggttggtggatgaaggaggatctggtgaggagtggggagtacttc
  I  R  V  P  V  G  W  W  M  K  E  D  L  V  R  S  G  E  Y  F cccaaaggcgggttcgcgtacctgcagagcttgtgcgagcatgctgcaagtaatggcatg
  P  K  G  G  F  A  Y  L  Q  S  L  C  E  H  A  A  S  N  G  M tatgtcattatcgaaatgcacggggccccggcacccagaatgctcagcagccgttcacg
  Y  V  I  I  E  M  H  G  A  P  G  T  Q  N  A  Q  Q  P  F  T ggaaattactctgacgccacctacttctaccaatccgactaccaatccgcccgcgcctac
  G  N  Y  S  D  A  T  Y  F  Y  Q  S  D  Y  Q  S  A  R  A  Y gacttcctcgtcttcctcacccacgccatccacacgcacccctcctccgcaccgtcggc
  D  F  L  V  F  L  T  H  A  I  H  T  H  P  S  F  R  T  V  G gccctcggcctcctcaacgagcccgtcttcaacaatcctctctccgccaacagccagtgg
  A  L  G  L  L  N  E  P  V  F  N  N  P  L  S  A  N  S  Q  W accgtctcgcacttctaccccctccgccatcgccgccatccgcgccgccgaagctgcgctc
  T  V  S  H  F  Y  P  S  A  I  A  A  I  R  A  A  E  A  A  L ggcgtgcgccctcccgccgccctcaccctcaccgtcatggacgacctctggctcgacctg
  G  V  R  P  P  A  A  L  T  L  T  V  M  D  D  L  W  L  D  L tccggccagtctgacccggccgcgcacctgacagatgcgcagcggcgaggcgtgctgtgg
  S  G  Q  S  D  P  A  A  H  L  T  D  A  Q  R  R  G  V  L  W gacgagcacaactaccaaagctcgcccgtcgcgaatatgaagcccgaggaggtggtcgcc
  D  E  H  N  Y  Q  S  S  P  V  A  N  M  K  P  E  E  V  V  A tatgcgtgtggggatgatcgaaggacggggcggcagccggggaagtaaagtttgtgggg
  Y  A  C  G  D  D  R  R  T  G  R  Q  P  G  E  V  K  F  V  G gagtggtcgatggcggtgcagcagaagggcgaaggcttcacgcccgagacggactacaag
  E  W  S  M  A  V  Q  Q  K  G  E  G  F  T  P  E  T  D  Y  K gcgttttggaaccaatacttcgcggcgctgcagtggaattatgagaggaccaggggctgg
  A  F  W  N  Q  Y  F  A  A  L  Q  W  N  Y  E  R  T  R  G  W gtgtggtggacgtggaaggctgagggggggcgaggctgcagaattggctgcagtggagt
  V  W  W  T  W  K  A  E  G  G  A  R  L  Q  N  W  L  Q  W  S tataagggcttagtcgagaatgggattgtgagtaaagatttgaattcgcaattggccttg
  Y  K  G  L  V  E  N  G  I  V  S  K  D  L  N  S  Q  L  A  L aatccttgcactggacactga
  N  P  C  T  G  H  -
```

SEQ ID NO: 363
LENGTH: 426
TYPE: PRT
ORGANISM: M. phaseolina
MSTFSTLPSTLVLLLSLLPLLTCAWLPTSCPPGISLSAFRTSPTNKIRGVNLGSQFIIEPWMARHEWAAMGCG

DAEAEFQCIKNQYGGDIARASQVWKKHWATWINGTDLDQMVQMGLNTIRVPVGWWMKEDLVRSGEYFPKGGFA

YLQSLCEHAASNGMYVIIEMHGAPGTQNAQQPFTGNYSDATYFYQSDYQSARAYDFLVFLTHAIHTHPSFRTV

GALGLLNEPVFNNPLSANSQWTVSHFYPSAIAAIRAAEAALGVRPPAALTLTVMDDLWLDLSGQSDPAAHLTD

AQRRGVLWDEHNYQSSPVANMKPEEVVAYACGDDRRTGRQPGEVKFVGEWSMAVQQKGEGFTPETDYKAFWNQ

YFAALQWNYERTRGWVWWTWKAEGGARLQNWLQWSYKGLVENGIVSKDLNSQLALNPCTGH*

-continued

SEQ ID NO: 364
LENGTH: 1617 (including 150 bp 5' UTR and 150 bp 3' UTR)
TYPE: DNA
ORGANISM: M. phaseolina
CGACCAAACCAGTACCCGCCCATTCCATTCTTTTCCGCCCTGGGCCATCCCAAGTCTTAGCGCTCGTTCATT

ATATATTCCGCAGAAGCTGTGTACATTATTGTGCAGGCCACACCCACACTCCTTCTCGATCGCGCTATTCAGC

CAAAATGAAGTACTCCACAATCCTTGGTCTGACCGCTGCTGTGACCCTTGCGGCTGCAAGCCCGGTGAAAAGA

CAATCATCTTTTGCTAAAGTCGATGGCTTGAAGTTCAATATCGACGGTGTAACCAAATACTACGCCGGCACAA

ATGCTTACTGGCTTGGATTCACAACGGGTGATGCCGACATCGACACTGCGCTCGACCGGCTCAAGGAATCCGG

TATCAAGCTTCTCCGCATTTGGGGCTTCAACGACGTCAACACGGTTCCCACTGACGGTAGGCTCATCTCAGCA

ACCCACAAGCGCATGGGTCTAATGTGATCCCAGGGACGGTTTGGTACCAGTCTTTTGTCGCTGGCCAGGACCC

GGTCATCAACACCGGTGCCAATGGCTTGCAGCGTCTGGACTATGTCGTCAAGTCGGCTGAGTCTCGCGGCATC

AAGCTGATTATCAACTTTGTCAACAACTGGACCGATTACGGAGGCATGGCCGCCTACATGAAGAGGTTTGGCG

GCTCGGCCAACCCGGACTGGTACGCCAATGCCGACATTCAGGCTCAGTACAAGAAGTACATCAAGGCCGTTGT

CTCACGCTACATCGACTCTCCGGCCATCTTCGCCTGGGAGCTGGCGAATGAGCCCCGCTGCAATGGCTGTGAC

ACCGTGAGAATTTCCGATACTATATCCGCTGCGCTGCGAGAAGCTGACAGATATCAAGTCTGTGATCTACGAC

TGGGCCAAGGAAACCAGCGCATACATCAAGAGCCTTGACGCCAACCACCTGGTTACCCTCGGCGATGAAGGAT

TCGGAGTAGCGGGTGGTGATGGCAGCTATCCCTACCAGGTACGTGCGCGACAATAACTACCAGTGGATTCTTT

TTGACAGCGCCGCAGAAGAGTGAGGGTGTCGATTTCAGCAAGAACCTCGAGATCGATACTCTCGACTACGGCA

CATTCCATCTCTACCCGGATTCCTGTAAGTTCGCCCTACTCATCATCTGGTCTCATGATGCTGACCGCTTTT

CAGGGGGTCAACCCAACGAACCGTTTGGCTCCGAGTGGGTTACTGCTCACGGCGCTGCCTGCGCTACCGCAGG

CAAGCCATGCATCTTTGAGGAGTATGGTGTGAAGACGGACAAGTGCAACATAGAAGGCAAATGGCAGTCGACG

GCTCTTAACACCACTGGCATCGCCGCCGATCAGTTCTGGGATTTCGGAACCACGCTCAGCTGGGGTCAAACCA

ACAACGATGGCAACACCATCTTCACGGGCACGTCCGACTGGGAGTGCCTGGTGACCAAGCACGTTGCCAACAT

TGGTTGAAGAAAAAGACGGCCCAGATGTCAGGAtTTATTCTTAGTTTCTTGCCGATATAACGTCCTTGTACAA

CAATTCACTTATGACGTAGCAGTCTCACGATCGAGGTGCCCATGTGCGCCGGCACTGTTAGCAAGTGTTCCGG

CGTCTAAATTG

SEQ ID NO: 365
LENGTH: 1110
TYPE: DNA
ORGANISM: M. phaseolina
FEATURE NAME/KEY: CDS
LOCATION: (1)...(1110)
atgaagtactccacaatccttggtctgaccgctgctgtgacccttgcggctgcaagcccg
 M   K   Y   S   T   I   L   G   L   T   A   A   V   T   L   A   A   A   S   P gtgaaaagacaatcatcttttgctaaagtcgatggcttgaagttcaatatcgacggtgta
 V   K   R   Q   S   S   F   A   K   V   D   G   L   K   F   N   I   D   G   V accaaatactacgccggcacaaatgcttactggcttggattcacaacgggtgatgccgac
 T   K   Y   Y   A   G   T   N   A   Y   W   L   G   F   T   T   G   D   A   D atcgacactgcgctcgaccggctcaaggaatccggtatcaagcttctccgcatttgggc
 I   D   T   A   L   D   R   L   K   E   S   G   I   K   L   L   R   I   W   G ttcaacgacgtcaacacggttcccactgacgggacggtttggtaccagtcttttgtcgct
 F   N   D   V   N   T   V   P   T   D   G   T   V   W   Q   S   F   V   A ggccaggacccggtcatcaacaccggtgccaatggcttgcagcgtctggactatgtcgtc
 G   Q   D   P   V   I   N   T   G   A   N   G   L   Q   R   L   D   Y   V   V aagtcggctgagtctcgcggcatcaagctgattatcaactttgtcaacaactggaccgat
 K   S   A   E   S   R   G   I   K   L   I   I   N   F   V   N   N   W   T   D tacggaggcatggccgcctacatgaagaggtttggcggctcggccaacccggactggtac
 Y   G   G   M   A   A   Y   M   K   R   F   G   G   S   A   N   P   D   W   Y

```
-continued
gccaatgccgacattcaggctcagtacaagaagtacatcaaggccgttgtctcacgctac
 A  N  A  D  I  Q  A  Q  Y  K  K  Y  I  K  A  V  V  S  R  Y atcgactctccggccatcttcgcctgggagctggcgaatgagccccgctgcaatggctgt
 I  D  S  P  A  I  F  A  W  E  L  A  N  E  P  R  C  N  G  C gacacctctgtgatctacgactgggccaaggaaaccagcgcatacatcaagagccttgac
 D  T  S  V  I  Y  D  W  A  K  E  T  S  A  Y  I  K  S  L  D gccaaccacctggttaccctcggcgatgaaggattcggagtagcgggtggtgatggcagc
 A  N  H  L  V  T  L  G  D  E  G  F  G  V  A  G  G  D  G  S tatccctaccagaagagtgagggtgtcgatttcagcaagaacctcgagatcgatactctc
 Y  P  Y  Q  K  S  E  G  V  D  F  S  K  N  L  E  I  D  T  L gactacggcacattccatctctacccggattcctggggtcaacccaacgaaccgtttggc
 D  Y  G  T  F  H  L  Y  P  D  S  W  G  Q  P  N  E  P  F  G tccgagtgggttactgctcacggcgctgcctgcgctaccgcaggcaagccatgcatcttt
 S  E  W  V  T  A  H  G  A  A  C  A  T  A  G  K  P  C  I  F gaggagtatggtgtgaagacggacaagtgcaacatagaaggcaaatggcagtcgacggct
 E  E  Y  G  V  K  T  D  K  C  N  I  E  G  K  W  Q  S  T  A cttaacaccactggcatcgccgccgatcagttctgggatttcggaaccacgctcagctgg
 L  N  T  T  G  I  A  A  D  Q  F  W  D  F  G  T  T  L  S  W ggtcaaaccaacaacgatggcaacaccatcttcacgggcacgtccgactgggagtgcctg
 G  Q  T  N  N  D  G  N  T  I  F  T  G  T  S  D  W  E  C  L gtgaccaagcacgttgccaacattggttga
 V  T  K  H  V  A  N  I  G  -

SEQ ID NO: 366
LENGTH: 369
TYPE: PRT
ORGANISM: M. phaseolina
MKYSTILGLTAAVTLAAASPVKRQSSFAKVDGLKFNIDGVTKYYAGTNAYWLGFTTGDADIDTALDRLKESGI

KLLRIWGFNDVNTVPTDGTVWYQSFVAGQDPVINTGANGLQRLDYVVKSAESRGIKLIINFVNNWTDYGGMAA

YMKRFGGSANPDWYANADIQAQYKKYIKAVVSRYIDSPAIFAWELANEPRCNGCDTSVIYDWAKETSAYIKSL

DANHLVTLGDEGFGVAGGDGSYPYQKSEGVDFSKNLEIDTLDYGTFHLYPDSWGQPNEPFGSEWVTAHGAACA

TAGKPCIFEEYGVKTDKCNIEGKWQSTALNTTGIAADQFWDFGTTLSWGQTNNDGNTIFTGTSDWECLVTKHV

ANIG*
```

INCORPORATION BY REFERENCE

All of the U.S. patents, U.S. published patent applications, and published PCT applications that cited herein are hereby incorporated by reference.

EQUIVALENTS

While several embodiments of the present invention have been described and illustrated herein, those of ordinary skill in the art will readily envision a variety of other means and/or structures for performing the functions and/or obtaining the results and/or one or more of the advantages described herein, and each of such variations and/or modifications is deemed to be within the scope of the present invention. Those skilled in the art will recognize, or be able to ascertain using no more than routine experimentation, many equivalents to the specific embodiments of the invention described herein. It is, therefore, to be understood that the foregoing embodiments are presented by way of example only and that, within the scope of the appended claims and equivalents thereto; the invention may be practiced otherwise than as specifically described and claimed.

SEQUENCE LISTING (610 sequences)

SEQ ID NO: 1 - DNA, 1159 bp, M. phaseolina
ctccagggatccttttctcttcactgcccatcagtcgctgtgcctctttaccttctgcttccaagcaagtccttcgctggtcgaactctcttttgctctttccattattcttgtcgatattttctggattcatactccccaatcaacaccatgaagggtttcctcgccatcctggcgaccgcctcggtcgtctccgcccacgccacctggcaggagctctgggttggcactcaggacaaggtgagcacttgtgctcgtctgcctcagagcaacagccccgtccaggacgtcacctccaacgccatgcgctgcaacgccaacccctcggccgcttcttccacttgctccgttgcggcaggtgacagcctgaccgttgagatgcaccagcagcccaacgaccgcagctgcaccaacgaggccatcggcggcaaccacttcggcccggtcatgatctacatgtccaaggtggccgacgccaccaagaacgtaggcgacggcgactggttcaaggttgcccaggacacctacaacggcaccgaggcttcttggggcaccgagatcctgaacgccaattgcggcaagagggccttcaccggtaagcactcgcaggcccccccccccttttttcccttttgctgttctccacctcttttctccctcctgaaagaagcgaccgaggacaagggaaagcgaaagtgagatgaacgcgaaggaaatgcagcgaactgacctttttattttccttctacacacagtccccaagactctcgcagccggcgattacctcgtccgcgccgaggccattgctctgcacagcgcaggcagcaagggcggcgcgcagttctacatgacctgtttccaggtcaaggtcacgggcggtggctccgcgacgcccaaaggcgtcaagttccccggcgcgtacaaggacagcgaccccggcatcctgatcaacatctaccagacccccctgacctacaccgccccgggccctgacgtctggactggttaagcatgggagttgtttcttccgagaattggttcttgtatatactattagcatggggttgaggtggagacgcaatgatacttgatgctggatgtgacttgagattcgccgtcggtgataagtcataacggagagtgatgtggaatggagtgc

SEQ ID NO: 2 - DNA, 699 bp, M. phaseolina
atgaagggtttcctcgccatcctggcgaccgcctcggtcgtctccgcccacgccacctggcaggagctctgggttggcactcaggacaaggtgagcacttgtgctcgtctgcctcagagcaacagccccgtccaggacgtcacctccaacgccatgcgctgcaacgccaacccctcggccgcttcttccacttgctccgttgcggcaggtgacagcctgaccgttgagatgcaccagcagcccaacgaccgcagctgcaccaacgaggccatcggcggcaaccacttcggcccggtcatgatctacatgtccaaggtggccgacgccaccaagaacgtaggcgacggcgactggttcaaggttgcccaggacacctacaacggcaccgaggcttcttggggcaccgagatcctgaacgccaattgcggcaagagggccttcaccgtccccaagactctcgcagccggcgattacctcgtccgcgccgaggccattgctctgcacagcgcaggcagcaagggcggcgcgcagttctacatgacctgtttccaggtcaaggtcacgggcggtggctccgcgacgcccaaaggcgtcaagttccccggcgcgtacaaggacagcgaccccggcatcctgatcaacatctaccagacccccctgacctacaccgccccgggccctgacgtctggactggttaa

SEQ ID NO: 3 - protein, 232 aa, M. phaseolina
MKGFLAILATASVVSAHATWQELWVGTQDKVSTCARLPQSNSPVQDVTSNAMRCNANPSAASSTCSVAAGDSLTVEMHQQPNDRSCTNEAIGGNHFGPVMIYMSKVADATKNVGDGDWFKVAQDTYNGTEASWGTEILNANCGKRAFTVPKTLAAGDYLVRAEAIALHSAGSKGGAQFYMTCFQVKVTGGGSATPKGVKFPGAYKDSDPGILINIYQTPLTYTAPGPDVWTG

SEQ ID NO: 4 - DNA, 1108 bp, M. phaseolina
atggcaatgccgaagattacatgtttctagaatccagtatataagacacttcactgcccatcatggttttgctctccagtgctggacacaagctcactttcgatcattaccctttacaccgcagccttacattctttccacttcctcacaatgaagttctccgccaccctcgctgctcttgctgccgcgaccctgagcagtgctcattgtaggctttcaccaagctttttcggcctccaacgagacctaacacttcatagacaccttccccgccttggtcaacgagggccaggttactgaggactggaagtatgtccgcatgacttccaaccactactcccacggccctgtcaccgacgtgacctcccaagacatccgctgctacgaggacccgtccaaacccaccacctcgactctgtccgtcaaggctggcaacactctcggcttcaccgtcgaccctaacgtctcccacccgggtactctccagttctacatggcaaaggcccccagcggaaccacggctgccaacttcaagggcgacggcgacgtgtggttcaagatcttcggccagggtcccaagattgccaacggccagctctcgtggccttcgcaaggttcgtgttcacgttagcgctatacccttaatcaatagaactaacagtgcccccgcgcaggtttgagccaggtcaacgtcaccatccccgagtccttgcccaacggcgactacctcttccgcgtcgagcacattgccctgcatagcgctggaagccagaatggcgcccagttctacatctcttgcggtcagatcaccgtcaccggtggcggcaacggcaaccctagccccaaggtcgccctgcccggcgcgtacaaggccacggaccccggtctgctcatcaacatctactaccccgtgcccaccagctacaccctccccggcccagccgtctggtctggttagagcgttgtctctgttagaggatttcaagcagggccataagggagcgggaaggctgctcgcggctcttctcttcacagtaaatatttgacaccgctgctataaatggatgaacatactttaacgactttgatcttgggcatattctttcga

SEQ ID NO: 5 - DNA, 696 bp, M. phaseolina
atgaagttctccgccaccctcgctgctcttgctgccgcgaccctgagcagtgctcattacaccttccccgccttggtcaacgagggccaggttactgaggactggaagtatgtccgcatgacttccaaccactactcccacggccctgtcaccgacgtgacctcccaagacatccgctgctacgaggacccgtccaaacccaccacctcgactctgtccgtcaaggctggcaacactctcggcttcaccgtcgaccctaacgtctcccacccgggtactctccagttctacatggcaaaggcccccagcggaaccacggctgccaacttcaagggcgacggcgacgtgtggttcaagatcttcggccagggtcccaagattgccaacggccagctctcgtggccttcgcaaggtttgagccaggtcaacgtcaccatccccgagtccttgcccaacggcgactacctcttccgcgtcgagcacattgccctgcatagcgctggaagccagaatggcgcccagttctacatctcttgcggtcagatcaccgtcaccggtggcggcaacggcaaccctagccccaaggtcgccctgcccggcgcgtacaaggccacggaccccggtctgctcatcaacatctactaccccgtgcccaccagctacaccctccccggcccagccgtctggtctggttag

SEQ ID NO: 6 - protein, 231 aa, M. phaseolina
MKFSATLAALAAATLSSAHYTFPALVNEGQVTEDWKYVRMTSNHYSHGPVTDVTSQDIRCYEDPSKPTTSTLSVKAGNTLGFTVDPNVSHPGTLQFYMAKAPSGTTAANFKGDGDVWFKIFGQGPKIANGQLSWPSQGLSQVNVTIPESLPNGDYLFRVEHIALHSAGSQNGAQFYISCGQITVTGGGNGNPSPKVALPGAYKATDPGLLINIYYPVPTSYTLPGPAVWSG

SEQ ID NO: 7 - DNA, 1086 bp, M. phaseolina
gctctccacggctggtccaaccgacttcattcactgccttctaccgctttcgctctcgctctctctccagattctctctttctcccagcgctagccgctcagtcaccactttctacccaccaaccaaccaaacacaccaaaccagcaaaaatgcacacctccgctactctcttcgctgccggcgctatggtcgcctctgttgccgcccacggccacgtttccgccattgtggtcaacggcaagagcttccagggctacgaccccagcttctcctaccagaaccctgcccccaaggtcgctggctggactgcccagaacctcgacaacggcttcgtcgagcccaactccttcagctccggcgacatcatctgccacaaggaggccaagcccggccaggcctacgtcgaggctgccgccggcgacgagctccagatccagtggagcacctggcccgactcgcacaagggccccgtcatcgactaccttgccagctgcggcggcgactgcaccaccgccgacaagacctcgctctccttcgtcaagttccaggccaagggtctcgtctccggcagcgcgcccggcacctgggccaccgacgacctgatctccaacaacttcacgcacacgaccaccctgcccgccagcctcgccccgggcaactacgtcctgcgccacgagatcatcgcgctccactcggcgggccaggagaacggcgcgcaggcctacccccagtgcatcaacgtcaaggtcaccggctccggcagcaccgagatctccggcggcaagaaggccaccgccttctacaccccgaccgaccccggcatcaagttcaacctctacaccaccttctccgagtaccccatgcccggtcccgctctctggtccgccgccgctgccaaggtccgccgccacatgcgcgacttccgcctcttctaagcggatcgcgttcttctgttttcacttgtcaatattgttaggaagcagcttttctgtgaatactgtttaactggaatgagatggaaagagcaagggggagggtgtcatggtggattgtggttgagagctattgaaagagaggacttcttc

SEQ ID NO: 8 - DNA, 786 bp, M. phaseolina
atgcacacctccgctactctcttcgctgccggcgctatggtcgcctctgttgccgcccacggccacgtttccgccattgtggtcaacggcaagagcttccagggctacgaccccagcttctcctaccagaaccctgcccccaaggtcgctggctggactgcccagaacctcgacaacggcttcgtcgagcccaactccttcagctccggcgacatcatctgccacaaggaggccaagcccggccaggcctacgtcgaggctgccgccggcgacgagctccagatccagtggagcacctggcccgactcgcacaagggccccgtcatcgactaccttgccagctgcggcggcgactgcaccaccgccgacaagacctcgctctccttcgtcaagttccaggccaagggtctcgtctccggcagcgcgcccggcacctgggccaccgacgacctgatctccaacaacttcacgcacacgaccaccctgcccgccagcctcgccccgggcaactacgtcctgcgccacgagatcatcgcgctccactcggcgggccaggagaacggcgcgcaggcctacccccagtgcatcaacgtcaaggtcaccggctccggcagcaccgagatctccggcggcaagaaggccaccgccttctacaccccgaccgaccccggcatcaagttcaacctctacaccaccttctccgagtaccccatgcccggtcccgctctctggtccgccgccgctgccaaggtccgccgccacatgcgcgacttccgcctcttctaa

SEQ ID NO: 9 - protein, 261 aa, M. phaseolina
MHTSATLFAAGAMVASVAAHGHVSAIVVNGKSFQGYDPSFSYQNPAPKVAGWTAQNLDNGFVEPNSFSSGDIICHKEAKPGQAYVEAAAGDELQIQWSTWPDSHKGPVIDYLASCGGDCTTADKTSLSFVKFQAKGLVSGSAPGTWATDDLISNNFTHTTTLPASLAPGNYVLRHEIIALHSAGQENGAQAYPQCINVKVTGSGSTEISGGKKATAFYTPTDPGIKFNLYTTFSEYPMPGPALWSAAAAKVRRHMRDFRLF

SEQ ID NO: 10 - DNA, 1283 bp, M. phaseolina
aagccacgacctttgcttgaaagatttgcttcttcagctcaggttctcacattcattcttttcacattatctgcatttgcggctagcccgtagccttctctctttctacccaccattcgttgacctaccttcactatcatcgctggcaagatgaagttctcccaattcactattgcggcccttgcgcctcttgtctcagctcactacttcttcgataccctcgtcattgatggccaggaaacgcaaagcatgcaatacgtccggtccaacactcgccaagccaagtacaacccgaccaagtggaaaaacacccgtgacgacatgacacctgatatggacgactttcgctgcaataagggggctttcacgtttgccggttcaactggaaccgccgaggtcaaggctgggtcgaagcttgccatgaagcttgccgttggagctactatgcaacatcctggcgctgctcttgtctacatgtccaaagcgccttccgccgcgaactcctatgaaggagacggagaatggttcaagatttttgaggaaagtgtctgcaatcagaatggggactttacgcgtgatgcctggtgcacttgggacaaagatcgtatcgagttcaccattcccgccgacacccctgacggagaatatctgatccgccctgagcatgtcggtaagtttccacttctgtccctacttatttgaccacctgactgacatttgtacagccgttcatggagctcatgttggtgaggccgagttctactatgggtaagctcttcagcaccttacccggcaagaagaagtatagtctgactctctgcagctgtgcccaggtcaaggttaccgggggtggcaatggtgtacctggtcccaccgtcaagttccctggagcgtacaagagcaccgacgagtcattcaatttcagtatctacggtggctacaagccataccctatgcctggtcctgctgtctggactgggggcaacagtgggagcagcagcggtaacaccacaaccgcaaacagcatagataccgccagcgccgatcccagtgctgaggaaacgtactcctgcagccgcgttaagctgccccgtaacagtcgctccttcagggactctctgcgtgaagactaagcgaaggacaccgtgcttccagtgccctgcagctgcatgcatcgacgacatgggcttttatatcccttctccggccgacatcacaaacattgaagaaagcatttgaggtacggttgatggacggtcggcggcggaaacagggtatcaaat

SEQ ID NO: 11 - DNA, 873 bp, M. phaseolina
atgaagttctcccaattcactattgcggcccttgcgcctcttgtctcagctcactacttcttcgataccctcgtcattgatggccaggaaacgcaaagcatgcaatacgtccggtccaacactcgccaagccaagtacaacccgaccaagtggaaaaacacccgtgacgacatgacacctgatatggacgactttcgctgcaataagggggctttcacgtttgccggttcaactggaaccgccgaggtcaaggctgggtcgaagcttgccatgaagcttgccgttggagctactatgcaacatcctggcgctgctcttgtctacatgtccaaagcgccttccgccgcgaactcctatgaaggagacggagaatggttcaagatttttgaggaaagtgtctgcaatcagaatggggactttacgcgtgatgcctggtgcacttgggacaaagatcgtatcgagttcaccattcccgccgacacccctgacggagaatatctgatccgccctgagcatgtcgccgttcatggagctcatgttggtgaggccgagttctactatggctgtgcccaggtcaaggttaccgggggtggcaatggtgtacctggtcccaccgtcaagttccctggagcgtacaagagcaccgacgagtcattcaatttcagtatctacggtggctacaagccataccctatgcctggtcctgctgtctggactgggggcaacagtgggagcagcagcggtaacaccacaaccgcaaacagcatagataccgccagcgccgatcccagtgctgaggaaacgtactcctgcagccgcgttaagctgccccgtaacagtcgctccttcagggactctctgcgtgaagactaa

SEQ ID NO: 12 - protein, 290 aa, M. phaseolina
MKFSQFTIAALAPLVSAHYFFDTLVIDGQETQSMQYVRSNTRQAKYNPTKWKNTRDDMTPDMDDFRCNKGAFTFAGSTGTAEVKAGSKLAMKLAVGATMQHPGAALVYMSKAPSAANSYEGDGEWFKIFEESVCNQNGDFTRDAWCTWDKDRIEFTIPADTPDGEYLIRPEHVAVHGAHVGEAEFYYGCAQVKVTGGGNGVPGPTVKFPGAYKSTDESFNFSIYGGYKPYPMPGPAVWTGGNSGSSSGNTTTANSIDTASADPSAEETYSCSRVKLPRNSRSFRDSLRED

SEQ ID NO: 13 - DNA, 1670 bp, M. phaseolina
ggatgttcactgctttctccgtctatcctcattagccagataaatacgcgatccgccgtgttgtcactcagatgcctcgtccttctccaaatcactgatcggcagcgccgtggccttttttgttcctccccactgtcttcagtctccaccatgcggtctattctgtccacttgcgcgctggtcgccgctgcttccgcgcacaccattttccaggagctctatgtcaacggcgtgtctcaggggcacactaccggcattcgcgtgcctgaatacgacgggtatgatgcttagctatttttcttgtctccgtctatccacacagcctcagcccctccgactcgtgtttaaacactccgagcatccgcaaagtgccgatcggccactaacatcaactactgccagccctatcaccgacgtcacctccaacgatgtcatctgtaacggcggggttaaccccttgaggactccactgccgagcgctgtcattgacgtatgtctgcctttcctctttttagcctccgcgaccttcatctccgcctcaaacgccaagcttcaccagtgcatgacatgtaccgctagcgagcctaggacattctcctggcgagtccgcttcggagaatcatgacaagtgcagccaagcatcgacaaaaacctacctctgccccacgctctccgactgtaaacaatacatttgagtcagcaaaaacagtcgggacgggaaagagatcagtcatggcatacatgagaaaggagtcggagcatttcgccccgggcgttaacgagaggaaacgtccgaggcgctcacgtccggtggaaagctccttttcccatcaagcgccttctctgctcggcgcagcggtgatctgggaaaccaaaacacgctgaacacttcccaatccggcacgtgcagagagcctcatcccgcgcacatactgctacctcaaacaccactaccactccacccacacaatcaaccaagctcgcgtcccctaaccgacttccaggttcccgccggcgccagcgtgaccgccgagttccaccacaccctgaagggcctcgacccgtccgacggcgacgacccgatcagcgcctcgcacaaaggccccatcatagcgtacctggccaaagtgcctgacgcgaagcagaccacggtcaccggcctctcgtggttcaagatctacgccgatgggctggacggcagctcgggcacgtgggcggtcgacaagctgatcaagaacaagggcaaggtcagcttcgccatccccaagtgcatcccggcgggcaactacctgctgcgcgtcgagctgattgccctgcacggcgcgagctcctacccgggcgcccagctgtacatggagtgcgcccagatcaacgtcaccggcggcaccggctccagcgttcccagcggcgtccgcttccccggcgcctacaagactaacgatcccggtatcttgtttaacttgtactaccccacccccacgacgtacactatccctggccctactgtgctcaagtgctagagagcctgctgcgcctcttggctttgcaagtgctttttgagggagagggaagaatgagtggcggggagagggttgttatccgtcttgtgaatgcttcatcttgattgagcctggccagaacagaagcagtgcattttctgtaaatacttt

SEQ ID NO: 14 - DNA, 732 bp, M. phaseolina
atgcggtctattctgtccacttgcgcgctggtcgccgctgcttccgcgcacaccattttccaggagctctatgtcaacggcgtgtctcaggggcacactaccggcattcgcgtgcctgaatacgacggccctatcaccgacgtcacctccaacgatgtcatctgtaacggcggggttaaccccttgaggactccactgccgagcgctgtcattgacgttcccgccggcgccagcgtgaccgccgagttccaccacaccctgaagggcctcgacccgtccgacggcgacgacccgatcagcgcctcgcacaaaggccccatcatagcgtacctggccaaagtgcctgacgcgaagcagaccacggtcaccggcctctcgtggttcaagatctacgccgatgggctggacggcagctcgggcacgtgggcggtcgacaagctgatcaagaacaagggcaaggtcagcttcgccatccccaagtgcatcccggcgggcaactacctgctgcgcgtcgagctgattgccctgcacggcgcgagctcctacccgggcgcccagctgtacatggagtgcgcccagatcaacgtcaccggcggcaccggctccagcgttcccagcggcgtccgcttccccggcgcctacaagactaacgatcccggtatcttgtttaacttgtactaccccacccccacgacgtacactatccctggccctactgtgctcaagtgctag

SEQ ID NO: 15 - protein, 243 aa, M. phaseolina
MRSILSTCALVAAASAHTIFQELYVNGVSQGHTTGIRVPEYDGPITDVTSNDVICNGGVNPLRTPLPSAVIDVPAGASVTAEFHHTLKGLDPSDGDDPISASHKGPIIAYLAKVPDAKQTTVTGLSWFKIYADGLDGSSGTWAVDKLIKNKGKVSFAIPKCIPAGNYLLRVELIALHGASSYPGAQLYMECAQINVTGGTGSSVPSGVRFPGAYKTNDPGILFNLYYPTPTTYTIPGPTVLKC

SEQ ID NO: 16 - DNA, 1196 bp, M. phaseolina
gttacatatataccagccgcaatgccttgtagctagggatcagcttcccactgctagccagttccttcgctcctaccaatctttgttctcattcgtttgacggcccggtgcctttttgaagcccttatccaatccactacagccaacaccatgtctctcaagtctctcgctattctcgccgctggcgcggcctccgtgaacgcccacggtgtcattctcgacatcgtctccgccggcaaggagtacggtggttgggacgtcaactaccagtactacaacccggtccctaaggttgctgcctgggccgccggtggctacggtcacggtcccattgtcggcacccagtacgccagcacctccatcaactgtcacgatgacgccaaggctgctcccatctacatggaggctgctgccggttccgatatcgagatctcttggggcacccccggctccaaccccagcccctgggtaagttccatctcttccacgacatagccctacctgagcctcaagctgaccgaaactcacagcccgaatcgcacaagggccccatcatcacctacatggcgccctgcggcaccgatgccaccggtgactgcacgaccgtcctgcccgacgacctcggctggaccaaggtctaccagaccggtctgctgaccggcggcgacaccagcgcccaggtctgggccaccgacaagctcatctccgagaacaagaccaccgtcaccatcccttcggcgctggcccccggcaactacgtcatgcgccacgagatcatcgcgctccacgccggcggcgaggtcaacggcccccagaactacccccagtgctacaacgtcaaggtcacaggctctggttccgagaagctgcccgccggtaccaagggcgtcaagctgtacgcacctgaggacactgttttcaacatctacgcaaacatcgactcgtaccccttccctggcccggaactttggagcggcgcttccagctcgtcgggtgctggcgctaacaccactactaagcgttgggctcgtaccttcaggggttaaagcgttgttccgatgaaggaaaatggtggttgggaaaggagaaaatacgataggacgtattcttgtagatattttttttttaaacgcttcgaacatttcttcctatacatactactttctgagcgtgggcggtccagtgcctcccttgtc

SEQ ID NO: 17 - DNA, 834 bp, M. phaseolina
atgtctctcaagtctctcgctattctcgccgctggcgcggcctccgtgaacgcccacggtgtcattctcgacatcgtctccgccggcaaggagtacggtggttgggacgtcaactaccagtactacaacccggtccctaaggttgctgcctgggccgccggtggctacggtcacggtcccattgtcggcacccagtacgccagcacctccatcaactgtcacgatgacgccaaggctgctcccatctacatggaggctgctgccggttccgatatcgagatctcttggggcacccccggctccaaccccagcccctggcccgaatcgcacaagggccccatcatcacctacatggcgccctgcggcaccgatgccaccggtgactgcacgaccgtcctgcccgacgacctcggctggaccaaggtctaccagaccggtctgctgaccggcggcgacaccagcgcccaggtctgggccaccgacaagctcatctccgagaacaagaccaccgtcaccatcccttcggcgctggcccccggcaactacgtcatgcgccacgagatcatcgcgctccacgccggcggcgaggtcaacggcccccagaactacccccagtgctacaacgtcaaggtcacaggctctggttccgagaagctgcccgccggtaccaagggcgtcaagctgtacgcacctgaggacactgttttcaacatctacgcaaacatcgactcgtaccccttccctggcccggaactttggagcggcgcttccagctcgtcgggtgctggcgctaacaccactactaagcgttgggctcgtaccttcaggggttaa

SEQ ID NO: 18 - protein, 277 aa, M. phaseolina
MSLKSLAILAAGAASVNAHGVILDIVSAGKEYGGWDVNYQYYNPVPKVAAWAAGGYGHGPIVGTQYASTSINCHDDAKAAPIYMEAAAGSDIEISWGTPGSNPSPWPESHKGPIITYMAPCGTDATGDCTTVLPDDLGWTKVYQTGLLTGGDTSAQVWATDKLISENKTTVTIPSALAPGNYVMRHEIIALHAGGEVNGPQNYPQCYNVKVTGSGSEKLPAGTKGVKLYAPEDTVFNIYANIDSYPFPGPELWSGASSSSGAGANTTTKRWARTFRG

SEQ ID NO: 19 - DNA, 1837 bp, M. phaseolina
ttcatcaccctcggccaacaacagtcacctgccgcttcccctgtccgagctctcgtcaagtcgttgcccactgctttttcgctgcacatattagcccgctgatcgagcattgaacttcctcaccagtacgctctgctttgatcaatcaacatgaaaatcttcgctgtcactttggccctggctgcttcgaccgtcgtcgaagcccacaccatcttcaccactctgtgggtcgacggcaagtccgtaggcgatggtgttggcgtccgcatgcgcaagactcccaagaccgccagcttccctatcagcctcggcgatgatgccatggcctgtggttacgatggcgaggagggcaacccgcgtgtcgtgcccgtcaacgacggcgccaccttgtccttcgagtggcgcgcctatggcagcaatcccagcaagggcgctattgatgctggccacaagggcccctgtgctgtctacctgaagaaggttgactccgctgtcaacgacactggtaagaaacacttcagaattcgacgcggttgtagtgctgacatactacaggcgtcggcgatggatggttcaaggtttgggatcaaggatacgatgagaagaagggcctgtggtgcaatcagatgctgggagaccaggatgagaacggtgtctacaaccacaagatttccatcgatctcccaaagggccttgaaggtggttattaccttgcccgtcctgagctgctagccctgcactcagcagtcgcgaaccctccggacccccagttctacactggctgcgcgcagatctttctccaatctaccggcaacaagcatccccaggatacggttagcatccctggctacatcaagtccaccgatgctagcgtcaccttcaacatctacaaggagccattggaactgccttaccttactccgggccctcccgtcgctgcactcgtcagcggtggtgctactgcagccgaggctagacagggcacccaacaggaagggctgcagccggatggttgcattatggagatggctggtttctgcgcctacgaggttccatcatacacagatgagactggctgctgggctgtaagtcatgctttccatcctaaccttcgattcccgccgctcaccgtccaatctagtctggagaagagtgctgggctcagcacaagaagtgctgggactactcggagaccattcccactggtggcgacccctggtgcactctttggggtgacaagtgtcagaacatcgacgacaactgcaatgcaaagaatttcaacgggccacccaacgcaaacaaggtgttgactcctcagctccctacaatggccagcatccccatggctctttcgaccaccaactacgagtctactactgccgcgtccgcgtccgccgccgccgtgaatgctgacagcgaggcctcgtctgcttctgagccgagctacgccgccccaaccacgacacttctcaccctttccagctccagcgccaaatccgagacatcggcttcatccaccgaggttgaagcttccccgagcacggcaacttcgtacaccacagctgcgcctgctgtcaagactacttacgagactgccttcgtgacggaaattgtgtatattaccgctggtgcgaagaacaagaggcgctccagacacttcggcaggcacggggtgaagccgtcgtagatgctagtgctgtttcatgagtggagctcctgcgcggttcggacggagggtttcactgcccacctgcttttctgatccaggtatcatctggcatgtgtaggcgtaggttgctcagccggacatgagcatcttcttttctccaaaaacctt

SEQ ID NO: 20 - DNA, 1431 bp, M. phaseolina
atgaaaatcttcgctgtcactttggccctggctgcttcgaccgtcgtcgaagcccacaccatcttcaccactctgtgggtcgacggcaagtccgtaggcgatggtgttggcgtccgcatgcgcaagactcccaagaccgccagcttccctatcagcctcggcgatgatgccatggcctgtggttacgatggcgaggagggcaacccgcgtgtcgtgcccgtcaacgacggcgccaccttgtccttcgagtggcgcgcctatggcagcaatcccagcaagggcgctattgatgctggccacaagggcccctgtgctgtctacctgaagaaggttgactccgctgtcaacgacactggcgtcggcgatggatggttcaaggtttgggatcaaggatacgatgagaagaagggcctgtggtgcaatcagatgctgggagaccaggatgagaacggtgtctacaaccacaagatttccatcgatctcccaaagggccttgaaggtggttattaccttgcccgtcctgagctgctagccctgcactcagcagtcgcgaaccctccggacccccagttctacactggctgcgcgcagatctttctccaatctaccggcaacaagcatccccaggatacggttagcatccctggctacatcaagtccaccgatgctagcgtcaccttcaacatctacaaggagccattggaactgccttaccttactccgggccctcccgtcgctgcactcgtcagcggtggtgctactgcagccgaggctagacagggcacccaacaggaagggctgcagccggatggttgcattatggagatggctggtttctgcgcctacgaggttccatcatacacagatgagactggctgctgggcttctggagaagagtgctgggctcagcacaagaagtgctgggactactcggagaccattcccactggtggcgacccctggtgcactctttggggtgacaagtgtcagaacatcgacgacaactgcaatgcaaagaatttcaacgggccacccaacgcaaacaaggtgttgactcctcagctccctacaatggccagcatccccatggctctttcgaccaccaactacgagtctactactgccgcgtccgcgtccgccgccgccgtgaatgctgacagcgaggcctcgtctgcttctgagccgagctacgccgccccaaccacgacacttctcaccctttccagctccagcgccaaatccgagacatcggcttcatccaccgaggttgaagcttccccgagcacggcaacttcgtacaccacagctgcgcctgctgtcaagactacttacgagactgccttcgtgacggaaattgtgtatattaccgctggtgcgaagaacaagaggcgctccagacacttcggcaggcacggggtgaagccgtcgtag

SEQ ID NO: 21 - protein, 476 aa, M. phaseolina
MKIFAVTLALAASTVVEAHTIFTTLWVDGKSVGDGVGVRMRKTPKTASFPISLGDDAMACGYDGEEGNPRVVPVNDGATLSFEWRAYGSNPSKGAIDAGHKGPCAVYLKKVDSAVNDTGVGDGWFKVWDQGYDEKKGLWCNQMLGDQDENGVYNHKISIDLPKGLEGGYYLARPELLALHSAVANPPDPQFYTGCAQIFLQSTGNKHPQDTVSIPGYIKSTDASVTFNIYKEPLELPYLTPGPPVAALVSGGATAAEARQGTQQEGLQPDGCIMEMAGFCAYEVPSYTDETGCWASGEECWAQHKKCWDYSETIPTGGDPWCTLWGDKCQNIDDNCNAKNFNGPPNANKVLTPQLPTMASIPMALSTTNYESTTAASASAAAVNADSEASSASEPSYAAPTTTLLTLSSSSAKSETSASSTEVEASPSTATSYTTAAPAVKTTYETAFVTEIVYITAGAKNKRRSRHFGRHGVKPS

SEQ ID NO: 22 - DNA, 1158 bp, M. phaseolina
ttggcactggcgagcgcgcgggttcgcgctcaatatataggggatgctgttactctgggttccaagactgggcaaggcgttccgcttgcttctcgatttccagatacccagagcagtaaagcttgatccattccagaaaacaaacgaaagatgcggtcggggaacattgcggcaggcctcttgcctgtttgggctagcctgagtgccatggtgcacgctcacgggtgcgtccctacattctctcccaccaaagaccggtcccagacgcggctgcaagaaggttgttgacttggccgagatgctgaccatccgatcgccagccacgtccaataccacgtcatgaactcggccacctacaccggctacctccccgtcaagacccccgacttcaccgccgacccgcccagcatcgtgcgcagggtcggcggcaacgggccggtgctcgacatcggcacgtccaacatcacctgcaacgtcggcgcggcgcccatcgccgacgcggacggccgctcgcgcacgggcgccgtgacggcgggcaccaacatcaccttcctgtggaacgagtggccgcactccgggccggtgctgacgtacatggccaagtgcgagccggactgcggctccttcaccggcagcgacggggccgtgtggttcaagatcgacgagtggggctaccgcgacggcgtgtgggggtcgcagaagctggtcgacgacggcaacagctggacgagcaccgtgcccgcgtgcctggcgcccggcgagtacctcgtccggcacgagatcatcgcgctgtccgactgcaagacgcagggcaagtgccagttctatcccagctgcgcgcaggtcaccgtcgagggcgacggcaccgcggcgccggccggcgacagcgtcattgcgctgcccggcggctacaagacggatgggacgggcattctgtgggacacgaacaagcagaagccggccgactacgtgactccggggcccgcggtcttccagtgccccagctgagcggaggaggtggaagtgcgcgctgaacggcatgtgggatgatgatcgagggggcggtatttgttcacttcttgggacatattatttttgaagaccaatctggcattgaacgactatgaaacacaagatacttcttggtgcaatctggct

SEQ ID NO: 23 - DNA, 762 bp, M. phaseolina
atgcggtcggggaacattgcggcaggcctcttgcctgtttgggctagcctgagtgccatggtgcacgctcacggccacgtccaataccacgtcatgaactcggccacctacaccggctacctccccgtcaagacccccgacttcaccgccgacccgcccagcatcgtgcgcagggtcggcggcaacgggccggtgctcgacatcggcacgtccaacatcacctgcaacgtcggcgcggcgcccatcgccgacgcggacggccgctcgcgcacgggcgccgtgacggcgggcaccaacatcaccttcctgtggaacgagtggccgcactccgggccggtgctgacgtacatggccaagtgcgagccggactgcggctccttcaccggcagcgacggggccgtgtggttcaagatcgacgagtggggctaccgcgacggcgtgtgggggtcgcagaagctggtcgacgacggcaacagctggacgagcaccgtgcccgcgtgcctggcgcccggcgagtacctcgtccggcacgagatcatcgcgctgtccgactgcaagacgcagggcaagtgccagttctatcccagctgcgcgcaggtcaccgtcgagggcgacggcaccgcggcgccggccggcgacagcgtcattgcgctgcccggcggctacaagacggatgggacgggcattctgtgggacacgaacaagcagaagccggccgactacgtgactccggggcccgcggtcttccagtgccccagctga

SEQ ID NO: 24 - protein, 253 aa, M. phaseolina
MRSGNIAAGLLPVWASLSAMVHAHGHVQYHVMNSATYTGYLPVKTPDFTADPPSIVRRVGGNGPVLDIGTSNITCNVGAAPIADADGRSRTGAVTAGTNITFLWNEWPHSGPVLTYMAKCEPDCGSFTGSDGAVWFKIDEWGYRDGVWGSQKLVDDGNSWTSTVPACLAPGEYLVRHEIIALSDCKTQGKCQFYPSCAQVTVEGDGTAAPAGDSVIALPGGYKTDGTGILWDTNKQKPADYVTPGPAVFQCPS

SEQ ID NO: 25 - DNA, 1413 bp, M. phaseolina
ttctttcaccggtctccgaccaaccacattctttccaccaagatcattcttcactgcgtgaagctgggatcttctttatcgctttgacagcagcctatctcttcgttcagccaaccaacacagtcttttcaccctcccctaccccttgccatgtctgctatcttcaagaacgccggtctgctcggcgccctcgccgccaccgccgctgcccacggcaccgtttcgggcattgtcatcgatggcaaatacacccagaactacaacccctccatgcagtaccagtctcctgctcccgtcgtcatcggctgggccatccccgaggatcaggacaacggcttcgtcgccccctcggcctactctgaccccgacatcatctgccacaagggtgcttccaacgcccagacctacgctaccgttgctgctggcgagaagatcgacatcgagtggaccacctggcccgactcgcacaagggccccgtcatttcctacctcgccccctgcggtggtgactgcaccaccgtcgacaaggagacgctcaagttcgtcaagatcgaccagggtggcctcaacgtggacacccagacctgggctgccaccgacctgattgccaacaacaacacctgggtcaccaccattccgtccagcgtcgcgcccggcaagtacgtcctccgccacgagatcatcgctctccacagcgccggctccgccgacggtgcccagaactacccccagtgcatgaacctcgagatcaccggctccggctccgacgacctgaccaccggcggcaccctcggcaccgccctgtacaaggaggacgacccgggcatcctcatcaacatctaccagaccctctccacctacgagatccccggccccaccctctactcgggcgcctcgtcgggctctgccaccgccgtcgccagctccgccgctgcttccaccccggctgctacctccgccgttgcctcgtcggccgctgccaccagcaccgccgtcgccgccgctgacgtctctaccacctccgccgccagcaccccgactgacctgactgccgtcgtccccagctccgtcctgtccgtccaggccaccgccatccccaccgcctcgggcgtcgccgtccccgagaccagcgtccccgacgacttcaccgtcaaggacatccttcagtggttcgcctacgtcatggagacctacttcaccaaggactcgagctcctcctccgctaaggtccgccgtcacgcccgtgacgtcaagctcaactaagcgcgagcggagagcatggaaaacgcttacgaaggaaatgtttctttttccttgagcaggagatgcgcatgtatttgtgacctgactggcaaaactctttgatattcttttggctgaactgagagatgttctgctgtttttacatacctt

SEQ ID NO: 26 - DNA, 1113 bp, M. phaseolina
atgtctgctatcttcaagaacgccggtctgctcggcgccctcgccgccaccgccgctgcccacggcaccgtttcgggcattgtcatcgatggcaaatacacccagaactacaacccctccatgcagtaccagtctcctgctcccgtcgtcatcggctgggccatccccgaggatcaggacaacggcttcgtcgccccctcggcctactctgaccccgacatcatctgccacaagggtgcttccaacgcccagacctacgctaccgttgctgctggcgagaagatcgacatcgagtggaccacctggcccgactcgcacaagggccccgtcatttcctacctcgccccctgcggtggtgactgcaccaccgtcgacaaggagacgctcaagttcgtcaagatcgaccagggtggcctcaacgtggacacccagacctgggctgccaccgacctgattgccaacaacaacacctgggtcaccaccattccgtccagcgtcgcgcccggcaagtacgtcctccgccacgagatcatcgctctccacagcgccggctccgccgacggtgcccagaactacccccagtgcatgaacctcgagatcaccggctccggctccgacgacctgaccaccggcggcaccctcggcaccgccctgtacaaggaggacgacccgggcatcctcatcaacatctaccagaccctctccacctacgagatccccggccccaccctctactcgggcgcctcgtcgggctctgccaccgccgtcgccagctccgccgctgcttccaccccggctgctacctccgccgttgcctcgtcggccgctgccaccagcaccgccgtcgccgccgctgacgtctctaccacctccgccgccagcaccccgactgacctgactgccgtcgtccccagctccgtcctgtccgtccaggccaccgccatccccaccgcctcgggcgtcgccgtccccgagaccagcgtccccgacgacttcaccgtcaaggacatccttcagtggttcgcctacgtcatggagacctacttcaccaaggactcgagctcctcctccgctaaggtccgccgtcacgcccgtgacgtcaagctcaactaa

SEQ ID NO: 27 - protein, 370 aa, M. phaseolina
MSAIFKNAGLLGALAATAAAHGTVSGIVIDGKYTQNYNPSMQYQSPAPVVIGWAIPEDQDNGFVAPSAYSDPDIICHKGASNAQTYATVAAGEKIDIEWTTWPDSHKGPVISYLAPCGGDCTTVDKETLKFVKIDQGGLNVDTQTWAATDLIANNNTWVTTIPSSVAPGKYVLRHEIIALHSAGSADGAQNYPQCMNLEITGSGSDDLTTGGTLGTALYKEDDPGILINIYQTLSTYEIPGPTLYSGASSGSATAVASSAAASTPAATSAVASSAAATSTAVAAADVSTTSAASTPTDLTAVVPSSVLSVQATAIPTASGVAVPETSVPDDFTVKDILQWFAYVMETYFTKDSSSSSAKVRRHARDVKLN

SEQ ID NO: 28 - DNA, 1106 bp, M. phaseolina
gaggtgcgggtactctttacccgtgaaacatgcgtcacctcgtggccagcggtctgaacttccgggacagataaagagggatgcgtttcccgtggatatttccatcaacagtcttggctgctcctttcaatatcacttcccagcgcgaacatgaagacctttgcaactttcgctcttgctgcttctgtgctggcacagactgtcagcggacactgtaagatgcaccttggggatggaggcccatctgaagaatcacgaactcatcgctgacgcccatttccacagacatctttgagtacctcaccgccaacggtgttaagggaggagcgtaccagaacatcaggcagaacacgaacaacaactcgcctgtgacagatctcgcctccaacgacctccgttgcaacgtcggcggcgctgatggtagcaagactagcacggtctcagtggccgccggcagctcggtcagcttcactgcagacattgctgtctaccaccagggccctacttcgttctacatgaccaaagtcgccgacgcctcgaaggcggacggcagtaccccgtggtttaagatcaaggacattggaccgaccgtaagccatattcaagacccctagcaaaaaagtatccgtcagctaacgcatcgccagttctctaacggtcaagcaacctgggatcttggaaccacttactccgtgactattcccaactgccttccggctggcgaatacctgctgcgtattcaacagcttgcaatccacaacccttggccggcgggaattcctcagttctacatttcttgcgctcaggtgaaggtgaccggtagcggttctggctcacccagcccaaccgtttctatccctggcgccttcaagaacactgacccgggttacacggtcaacatctacaacaacttcaacaattacacggttcccggtccggcggtctggaagtgctagatggaacagacgtgaaacgccggttacgctggaagggggcgtggtggggattgccggttggccaaatggcagaaactccagttgtgtatagtggccaccttcttcaatggacatacttatcgtaactcgtcactttcaatcgtcactgtg

SEQ ID NO: 29 - DNA, 678 bp, M. phaseolina
atgaagacctttgcaactttcgctcttgctgcttctgtgctggcacagactgtcagcggacactacatctttgagtacctcaccgccaacggtgttaagggaggagcgtaccagaacatcaggcagaacacgaacaacaactcgcctgtgacagatctcgcctccaacgacctccgttgcaacgtcggcggcgctgatggtagcaagactagcacggtctcagtggccgccggcagctcggtcagcttcactgcagacattgctgtctaccaccagggccctacttcgttctacatgaccaaagtcgccgacgcctcgaaggcggacggcagtaccccgtggtttaagatcaaggacattggaccgaccttctctaacggtcaagcaacctgggatcttggaaccacttactccgtgactattcccaactgccttccggctggcgaatacctgctgcgtattcaacagcttgcaatccacaacccttggccggcgggaattcctcagttctacatttcttgcgctcaggtgaaggtgaccggtagcggttctggctcacccagcccaaccgtttctatccctggcgccttcaagaacactgacccgggttacacggtcaacatctacaacaacttcaacaattacacggttcccggtccggcggtctggaagtgctag

SEQ ID NO: 30 - protein, 225 aa, M. phaseolina
MKTFATFALAASVLAQTVSGHYIFEYLTANGVKGGAYQNIRQNTNNNSPVTDLASNDLRCNVGGADGSKTSTVSVAAGSSVSFTADIAVYHQGPTSFYMTKVADASKADGSTPWFKIKDIGPTFSNGQATWDLGTTYSVTIPNCLPAGEYLLRIQQLAIHNPWPAGIPQFYISCAQVKVTGSGSGSPSPTVSIPGAFKNTDPGYTVNIYNNFNNYTVPGPAVWKC

SEQ ID NO: 31 - DNA, 1028 bp, M. phaseolina
agctttgtcctgttagctgacaatagtctgactgctcgacagacctgctgagctggtcaatatttaaagacaatgctggctcctcctgtgaggagacagcaaatctgtcagcactattctcagctccattctcccttgaagtaattcaccatgttctctccgctctgggccctgtcggctctgctcctatttcctgccactgaagccactagcggcgtgacaaccaggtactgggactgctgcaagccgtcttgtgcttggacgggcaaagcatccgtctccaagcccgtcggaacctgcgacatcaacgacaacgcccagacgccgagcgatctgctcaagtcgtcctgtgatggcggcagcgcctactactgcagcaaccagggcccatgggccgtgaacgacagcctttcctacggcttcgctgccgccaagctgtccggaaagcaggagactgattggtgctgtggctgctacaagtaagcaaagacccgtcttccttcacaaccccttaattcctttactaacgtctgcaaagactcacattcacctccaccgccgtttccggcaagcaaatgatcgtgcaaatcacgaacacgggcggcgacctcggcaacaaccacttcgacatcgccatgccgggcggcggcgtcggcatcttcaacgggtgctccaagcaatggaacggcatcaatctgggcaaccagtatggcggcttcactgaccgctcgcaatgtgcgacgctcccgtccaagtggcaggccagctgcaactggcgcttcgactggttcgagaatgccgacaaccccaccgtcgattgggagcctgtcacttgcccacaggaattggtcgcccggactggctgttcccgtacctaagtgggggtggaacctccatgtgaattggtgtatatagctcctgcctgagcatccaccagttcgcatgtgttgatcaggagttgtgttgccttgctaggaaagactttgttggaaacttgcgtgtttattccaattgaataaccctgtata

SEQ ID NO: 32 - DNA, 669 bp, M. phaseolina
atgttctctccgctctgggccctgtcggctctgctcctatttcctgccactgaagccactagcggcgtgacaaccaggtactgggactgctgcaagccgtcttgtgcttggacgggcaaagcatccgtctccaagcccgtcggaacctgcgacatcaacgacaacgcccagacgccgagcgatctgctcaagtcgtcctgtgatggcggcagcgcctactactgcagcaaccagggcccatgggccgtgaacgacagcctttcctacggcttcgctgccgccaagctgtccggaaagcaggagactgattggtgctgtggctgctacaaactcacattcacctccaccgccgtttccggcaagcaaatgatcgtgcaaatcacgaacacgggcggcgacctcggcaacaaccacttcgacatcgccatgccgggcggcggcgtcggcatcttcaacgggtgctccaagcaatggaacggcatcaatctgggcaaccagtatggcggcttcactgaccgctcgcaatgtgcgacgctcccgtccaagtggcaggccagctgcaactggcgcttcgactggttcgagaatgccgacaaccccaccgtcgattgggagcctgtcacttgcccacaggaattggtcgcccggactggctgttcccgtacctaa

SEQ ID NO: 33 - protein, 222 aa, M. phaseolina
MFSPLWALSALLLFPATEATSGVTTRYWDCCKPSCAWTGKASVSKPVGTCDINDNAQTPSDLLKSSCDGGSAYYCSNQGPWAVNDSLSYGFAAAKLSGKQETDWCCGCYKLTFTSTAVSGKQMIVQITNTGGDLGNNHFDIAMPGGGVGIFNGCSKQWNGINLGNQYGGFTDRSQCATLPSKWQASCNWRFDWFENADNPTVDWEPVTCPQELVARTGCSRT

SEQ ID NO: 34 - DNA, 1410 bp, M. phaseolina
tccatcagacatgattcaacatctgcatttcatataaataagtgagcgtctgctgctcccactttctttgttctccaagcccagctgctcgctcccgccttgccattcctttcttcatacctgccgatcgcttcattctttaccttcatcatgcgtctttccactcttcttattgccggttcggcctccctcgcgctggctgcgccagtgcaaaaggaagagaagcgtgcttccaacttccaattcttcggtgtcaacgagtccggtcctgagtttggcgagaccaagcttcccggtaccaagaacactgactatgtctggcccactctttccactattgataccttcgtcggcaagggaatgaacactttccgtgtcaatatcctgatggaacgtctgactcacaactccctgaccgcctccctcgactctcagtacctggcagacttgaagacaacggtcaactacatcaccggcaagggtgcctacgccatgatcgtcccccacaactatggccgtaagcttgtcttacccaacacgtgtcaagatacctttactcacagcatctccaggcttcaactcgcagatcatcaccgacaccgcgggtttcaagacttggtggaccaacgtcgccaaggaattcgccggcaacagcaaagtcatcttcgacatcaacaacgagttccacgacatggaccagacccttgtcgtcaaccttaaccaggctggtatcgacggtatccgtgctgctggtgctaccagccagtacatcacggctgagggcaactcgtggactggtgcctggacttggacgacctccgagaacggcaaaaccatggctgctctcaaggatccccagaacaagctcatctaccagatgcaccagtacctcgacagcgatggcagcggcactaacgaggcttgcgtctccagcaccatcggcaaggagcgtatcacggccgctaccaagtggcttaaggataacggcaagaagggcctcatcggagagtttgctggcggcaacaacagccagtgcaagactgccgtcgagggaatgctcacttatatgcaagagaacaaggatgtctggacgggtgccctctggtgggctgctggaccatggataagtcttccaccacccccttttggaaaacattcagctaacaacagacgcactgggcctcttacatgtacagcatggagcctaagaccggaaccgcatacactgcctaccttgacctcatctccaaattcaaatagatgatcgccgtttgctggctgtcaggtcgaattcgtttgcgaggcgggttcttgcttcgattgtatatattttgatgaccgcttcgccgggaaaattaaaaaaagatatctctactgaaacccttcaattcttgcatcgaccccacagga

SEQ ID NO: 35 - DNA, 963 bp, M. phaseolina
atgcgtctttccactcttcttattgccggttcggcctccctcgcgctggctgcgccagtgcaaaaggaagagaagcgtgcttccaacttccaattcttcggtgtcaacgagtccggtcctgagtttggcgagaccaagcttcccggtaccaagaacactgactatgtctggcccactctttccactattgataccttcgtcggcaagggaatgaacactttccgtgtcaatatcctgatggaacgtctgactcacaactccctgaccgcctccctcgactctcagtacctggcagacttgaagacaacggtcaactacatcaccggcaagggtgcctacgccatgatcgtcccccacaactatggccgcttcaactcgcagatcatcaccgacaccgcgggtttcaagacttggtggaccaacgtcgccaaggaattcgccggcaacagcaaagtcatcttcgacatcaacaacgagttccacgacatggaccagacccttgtcgtcaaccttaaccaggctggtatcgacggtatccgtgctgctggtgctaccagccagtacatcacggctgagggcaactcgtggactggtgcctggacttggacgacctccgagaacggcaaaaccatggctgctctcaaggatccccagaacaagctcatctaccagatgcaccagtacctcgacagcgatggcagcggcactaacgaggcttgcgtctccagcaccatcggcaaggagcgtatcacggccgctaccaagtggcttaaggataacggcaagaagggcctcatcggagagtttgctggcggcaacaacagccagtgcaagactgccgtcgagggaatgctcacttatatgcaagagaacaaggatgtctggacgggtgccctctgcatggagcctaagaccggaaccgcatacactgcctaccttgacctcatctccaaattcaaatag

SEQ ID NO: 36 - protein, 320 aa, M. phaseolina
MRLSTLLIAGSASLALAAPVQKEEKRASNFQFFGVNESGPEFGETKLPGTKNTDYVWPTLSTIDTFVGKGMNTFRVNILMERLTHNSLTASLDSQYLADLKTTVNYITGKGAYAMIVPHNYGRFNSQIITDTAGFKTWWTNVAKEFAGNSKVIFDINNEFHDMDQTLVVNLNQAGIDGIRAAGATSQYITAEGNSWTGAWTWTTSENGKTMAALKDPQNKLIYQMHQYLDSDGSGTNEACVSSTIGKERITAATKWLKDNGKKGLIGEFAGGNNSQCKTAVEGMLTYMQENKDVWTGALCMEPKTGTAYTAYLDLISKFK

SEQ ID NO: 37 - DNA, 1995 bp, M. phaseolina
ctaaactccttggcccttcacaagatctgcatgaccgcttgtgccccgcaaggtctcgggaaaatcattcgataggctgtttaagaatgggcgttctctgcagttccgggggaatgctgcgatcaacctcttgcaccgtcctgatcgctaatgcacatggcgaccggcatcctgagagtagacggcgagaatgtcgtcggcaacgatgggaaacctgtcatccttcgcggcgccggcttgggaggatggatgaagtgagtgatgctgtccaccgttactggccttgtatcggatgttgactatccacagcatggagaacttcatcacaggctatccaggccacgagcatcaacaccgcgccgccatgcttaaggtgctcggaaaggaaaagtatgagttcttttttgacaagtggttggagtatttcttcaccgaaagggatgccaccttcttcgccagcaagggcctaaactgccttcgactgcccttcaactaccgtcactttgaagacgacatgaacccgcgggtgctcaagcagtccggtttcaagcatctcgaccgcgtcgtcgacctgtgtgcaaagcacaaaatctacacgtaggcaacttcattcccaacatgagaaattgagaagaatctgacacgcaacgggccgacccagcatcctcgacatgcatacagtaccgggcggccagaacggcgactggcattcggacaatgtaaccaactacgccgcgttctgggactacaaggaccaccaagatcgcaccgtctggctgtgggagcaaattgcccagcgctacaaggataatccatgggttgccggctataatccgatcaatgagccttgcgaccccgagcactggagattgcctgcattctatgatcgtattgaggcagccatccgcaaaattgatcctaaccacattttgtggctggatgggaacacctttgccatggagtggaagtacttcgacaagaagctgccgaacaccgtctacgccctgcatgactacacggtacagactgccgtcgccttttcacaagccatgtaactgacatcttcagatgatgggcttccccaaaggcgagaaattcataggctccgccgagcaaaaatccaaactcgagcgccaattcgttcgcaagtgcgaattccactacaagttccagacgccaatctggaacggtaaatatctgtgccgcacctcaaccaacgccgcactaacatgaacaggggagttcggcccggtctacgccaatccggagctcgacgaagaccactccgacgtcaacgaggcgcgctacaacgtcctgtccgagcagcttaacatctacgacaagtacaaaatacactggagcatctggctgtacaaggacatcggcgtgcagggcatggtacacactagccctcagagcaaatggaaccgcaccatcgcgccgttcctgaagcgcaaacgcgaactacagctcgatgcctggggccgctatcccagcaagcaggtcgaggacgttatcaatccgctcgtcgattggatcgacaaggttgcgcccacgagcaagttgcagtaccctacgccctgggctacggagcgccaggtcactcgtctgatcaatcagatctggttgtcttcctgcttgcaagacgagtttgcggagttgtttaggggtatgggtttcgaggagttggaggagtgtgctaagagcttcgctttcgagcgttgcatccagcgcgagggcttgaacaaggcgctggaggatcacagtgcggtgcccgaagttaccgctgactggaagcgtccggagttccgcaagtcagaccccaatgaggccattggtgtgtgaacagtctggaagcacggagtcaattctcgaaacagataatgcaaacttaaggccattacaggttatcatttccggctatagcatccgttttctacgagagttaaacaatatatactgcgcttagatatggctaacattggacggcgggtg

SEQ ID NO: 38 - DNA, 1479 bp, M. phaseolina
atgcacatggcgaccggcatcctgagagtagacggcgagaatgtcgtcggcaacgatgggaaacctgtcatccttcgcggcgccggcttgggaggatggatgaacatggagaacttcatcacaggctatccaggccacgagcatcaacaccgcgccgccatgcttaaggtgctcggaaaggaaaagtatgagttcttttttgacaagtggttggagtatttcttcaccgaaagggatgccaccttcttcgccagcaagggcctaaactgccttcgactgcccttcaactaccgtcactttgaagacgacatgaacccgcgggtgctcaagcagtccggtttcaagcatctcgaccgcgtcgtcgacctgtgtgcaaagcacaaaatctacaccatcctcgacatgcatacagtaccgggcggccagaacggcgactggcattcggacaatgtaaccaactacgccgcgttctgggactacaaggaccaccaagatcgcaccgtctggctgtgggagcaaattgcccagcgctacaaggataatccatgggttgccggctataatccgatcaatgagccttgcgaccccgagcactggagattgcctgcattctatgatcgtattgaggcagccatccgcaaaattgatcctaaccacattttgtggctggatgggaacacctttgccatggagtggaagtacttcgacaagaagctgccgaacaccgtctacgccctgcatgactacacgatgatgggcttccccaaaggcgagaaattcataggctccgccgagcaaaaatccaaactcgagcgccaattcgttcgcaagtgcgaattccactacaagttccagacgccaatctggaacggggagttcggcccggtctacgccaatccggagctcgacgaagaccactccgacgtcaacgaggcgcgctacaacgtcctgtccgagcagcttaacatctacgacaagtacaaaatacactggagcatctggctgtacaaggacatcggcgtgcagggcatggtacacactagccctcagagcaaatggaaccgcaccatcgcgccgttcctgaagcgcaaacgcgaactacagctcgatgcctggggccgctatcccagcaagcaggtcgaggacgttatcaatccgctcgtcgattggatcgacaaggttgcgcccacgagcaagttgcagtaccctacgccctgggctacggagcgccaggtcactcgtctgatcaatcagatctggttgtcttcctgcttgcaagacgagtttgcggagttgtttaggggtatgggtttcgaggagttggaggagtgtgctaagagcttcgctttcgagcgttgcatccagcgcgagggcttgaacaaggcgctggaggatcacagtgcggtgcccgaagttaccgctgactggaagcgtccggagttccgcaagtcagaccccaatgaggccattggtgtgtga

SEQ ID NO: 39 - protein, 492 aa, M. phaseolina
MHMATGILRVDGENVVGNDGKPVILRGAGLGGWMNMENFITGYPGHEHQHRAAMLKVLGKEKYEFFFDKWLEYFFTERDATFFASKGLNCLRLPFNYRHFEDDMNPRVLKQSGFKHLDRVVDLCAKHKIYTILDMHTVPGGQNGDWHSDNVTNYAAFWDYKDHQDRTVWLWEQIAQRYKDNPWVAGYNPINEPCDPEHWRLPAFYDRIEAAIRKIDPNHILWLDGNTFAMEWKYFDKKLPNTVYALHDYTMMGFPKGEKFIGSAEQKSKLERQFVRKCEFHYKFQTPIWNGEFGPVYANPELDEDHSDVNEARYNVLSEQLNIYDKYKIHWSIWLYKDIGVQGMVHTSPQSKWNRTIAPFLKRKRELQLDAWGRYPSKQVEDVINPLVDWIDKVAPTSKLQYPTPWATERQVTRLINQIWLSSCLQDEFAELFRGMGFEELEECAKSFAFERCIQREGLNKALEDHSAVPEVTADWKRPEFRKSDPNEAIGV

SEQ ID NO: 40 - DNA, 2095 bp, M. phaseolina
tgccctgcggcgattttgctcccaccggctcttcaagtcttgagtccctcgttgactactgtagctttgcggtctttgccctgagcatctggtctttgaggggattcttcgttcgatctttctttttgattttgctacatcctcccaacgatgaggtccttcctttacgctgccggtctcgcgcagctgggccgtctggcctctgcgctgcctctttcggcttacgcatcagcgtctgccgccacgtgcaatgggactttcaacgccatcactgctcagcaatttgtcgatcgcatgaacccgggctggaacttgggaaacacgctggacgcgattgaggatgagggcgactggaacaacgccccggttactgaagttacctttgacgatgtcaagaaggctggcttcaagggcattcgtctgcctggtaagtattccatatgccgtctcaactgttcgtattctaactccatcttcagtcacttgggcataccactttacctccgaggcacccgactacaccgttgaccctgcttggctgcagcgtgttgaggatgtggttgacatgatcactgctcgtgatttctacgccattgtcaacgttcaccatgacagctggaactgggccgatatgaccgccagtggagcgaactacacactcattgaagagaagttctataagctttggtaccagattggtgagaagctcgcttgcaagtctgagctagttgccttcgagcccatcaacgagcctccgggtaccactgccgagcacggcgctgaactgaacaagctcaacaacatcttcttgaaggcgatcaacgatgctggtggattcaacgcgcagcgtgtggtcactctccctggtctgggggaggacagcatcaagaccagcacatggttcgagccgccgagcgccaacttcaccaacccctgggccatccagtaccactactactctccttacgacttcatcttcagcgcctggggcaagaccaggtggggttctgatgcggacaaggctgctcttgaggcggacattgccaatatccgcaacaactttactgatgttcctctcattatcggcgagtgggccgcttcgcctgtggccacagagtcggcagcccgctggaagtacttcgacttcatcatccggaccgccaaaaagtacaatacctccactgtcctttgggacaacggcgccgacttcctcgaccgcaacacccatacctggcgcgatcagactgccatcgacatctacctgaacgcggtccagggcgtcgagaactcgctgcccgacagcaccgaggacggtcaggccaccagccagttcacctccgcctacatctggcaccaggttggcacccccgtgacctcgcagagcctgcctttcctcttcaacggcaacactctctccagcgtcagtgtcggcggcaacccgctcgccgagggcagcgactactcgaccaacggctccagcatcagcttctccgaatccttcctgtcacagcacctctccgccgacgcagcgcctggcgtcaaggccaaccttacgctctcattctctgctggcgccgacatcgaagtccagatcgtgcagtgggacgtcccgacgctcgccaccaacggcaccacggctgcggccgccgacaccgggtcggacctccgcatcccgatcacctggaagggcttgaacaagccggcaacggtcaaggcgctgacaacggacggcaccatcctcgtggacgactggacgcagtacctgggcccgctcgagaaggcgcacatcacgtacaacaaccagtggaactgggacgcgtcgaacatcctgctcaccagcagcgccgtcaaggctgtcgtcagcgcggccaagacgaccgtcttcacgatcgaattctacccgcgcgtgccgggcaacgcggtcaactacacgcttacggtttagatggggaaacccgccctgtggaatgggcggcacgaccgaagggactcttttgacttcttgcatatagcttggggcattcaaacttccggactttcttgtacatagattttgcaaatttgatgcttgacgcaagatttggaagatgagcgc

SEQ ID NO: 41 - DNA, 1743 bp, M. phaseolina
atgaggtccttcctttacgctgccggtctcgcgcagctgggccgtctggcctctgcgctgcctctttcggcttacgcatcagcgtctgccgccacgtgcaatgggactttcaacgccatcactgctcagcaatttgtcgatcgcatgaacccgggctggaacttgggaaacacgctggacgcgattgaggatgagggcgactggaacaacgccccggttactgaagttacctttgacgatgtcaagaaggctggcttcaagggcattcgtctgcctgtcacttgggcataccactttacctccgaggcacccgactacaccgttgaccctgcttggctgcagcgtgttgaggatgtggttgacatgatcactgctcgtgatttctacgccattgtcaacgttcaccatgacagctggaactgggccgatatgaccgccagtggagcgaactacacactcattgaagagaagttctataagctttggtaccagattggtgagaagctcgcttgcaagtctgagctagttgccttcgagcccatcaacgagcctccgggtaccactgccgagcacggcgctgaactgaacaagctcaacaacatcttcttgaaggcgatcaacgatgctggtggattcaacgcgcagcgtgtggtcactctccctggtctgggggaggacagcatcaagaccagcacatggttcgagccgccgagcgccaacttcaccaacccctgggccatccagtaccactactactctccttacgacttcatcttcagcgcctggggcaagaccaggtggggttctgatgcggacaaggctgctcttgaggcggacattgccaatatccgcaacaactttactgatgttcctctcattatcggcgagtgggccgcttcgcctgtggccacagagtcggcagcccgctggaagtacttcgacttcatcatccggaccgccaaaaagtacaatacctccactgtcctttgggacaacggcgccgacttcctcgaccgcaacacccatacctggcgcgatcagactgccatcgacatctacctgaacgcggtccagggcgtcgagaactcgctgcccgacagcaccgaggacggtcaggccaccagccagttcacctccgcctacatctggcaccaggttggcacccccgtgacctcgcagagcctgcctttcctcttcaacggcaacactctctccagcgtcagtgtcggcggcaacccgctcgccgagggcagcgactactcgaccaacggctccagcatcagcttctccgaatccttcctgtcacagcacctctccgccgacgcagcgcctggcgtcaaggccaaccttacgctctcattctctgctggcgccgacatcgaagtccagatcgtgcagtgggacgtcccgacgctcgccaccaacggcaccacggctgcggccgccgacaccgggtcggacctccgcatcccgatcacctggaagggcttgaacaagccggcaacggtcaaggcgctgacaacggacggcaccatcctcgtggacgactggacgcagtacctgggcccgctcgagaaggcgcacatcacgtacaacaaccagtggaactgggacgcgtcgaacatcctgctcaccagcagcgccgtcaaggctgtcgtcagcgcggccaagacgaccgtcttcacgatcgaattctacccgcgcgtgccgggcaacgcggtcaactacacgcttacggtttag

SEQ ID NO: 42 - protein, 580 aa, M. phaseolina
MRSFLYAAGLAQLGRLASALPLSAYASASAATCNGTFNAITAQQFVDRMNPGWNLGNTLDAIEDEGDWNNAPVTEVTFDDVKKAGFKGIRLPVTWAYHFTSEAPDYTVDPAWLQRVEDVVDMITARDFYAIVNVHHDSWNWADMTASGANYTLIEEKFYKLWYQIGEKLACKSELVAFEPINEPPGTTAEHGAELNKLNNIFLKAINDAGGFNAQRVVTLPGLGEDSIKTSTWFEPPSANFTNPWAIQYHYYSPYDFIFSAWGKTRWGSDADKAALEADIANIRNNFTDVPLIIGEWAASPVATESAARWKYFDFIIRTAKKYNTSTVLWDNGADFLDRNTHTWRDQTAIDIYLNAVQGVENSLPDSTEDGQATSQFTSAYIWHQVGTPVTSQSLPFLFNGNTLSSVSVGGNPLAEGSDYSTNGSSISFSESFLSQHLSADAAPGVKANLTLSFSAGADIEVQIVQWDVPTLATNGTTAAAADTGSDLRIPITWKGLNKPATVKALTTDGTILVDDWTQYLGPLEKAHITYNNQWNWDASNILLTSSAVKAVVSAAKTTVFTIEFYPRVPGNAVNYTLTV

SEQ ID NO: 43 - DNA, 1476 bp, M. phaseolina
ccatcaattgagaatgagtggcatgaggcgtaagagggacgctcaggggagtcctcttatcagtcctcttccgtgactaagctaaagtttattgtacacacacgtgatattccaacaaattctttcttctctctacggactcacttcacgatgaagaccgctactctcgccgctgcggcgtcccttttcacttccgccgccctcgccgcacccaccagcaccttgaaggctgctgccgcctccaaggtcaagttcgccggcgtcaacattgccggcttcgacttcggctgcggcacagatggaacctgcacacagaccgcatcaaccgccaccgaccccttgaccgactccgacggccagggtcaaatggaccactttgtcaaggacgacaagctcaacgcattccgcctgcccgtcggctggcagtacctggtcgccaacaagctcggcggcgacctagactcggccaacgccggtaaatacgacaatcttgtccaggggtgtctcaagtccggggccgagctctgtatcatcgacatccataactacgcccgctggaacggccagatcatcggccagggtggccccaccaacgaccagttcgtctcgctctggaagcagctggctacaaagtacaaggacaacaccaaggtggcgttcggggtcatgaatgagccccacgacgtgcccgacatcaacaagtgggccgacacggtccagcaggtcgtcaccgccatccgcaatgctggcgcaacgacgcaatacgtgctcctgccgggcaatgactggacgagcgccgcggccttcattgataatggctctgcggcggcgttgaagaaggtgaccaaccccgacggctcgaccgacaacctgatcttcgacgtgcacaagtacctcgacagcgataactcgggcacgcatactgagtgcgtgacaaacaacatcgacgatgcgttcaagccgcttgccgactggttgaggcagaacaagcgcatggcgatcaacacggagagcggtggcggcaacaccgactcttgcgagaaatacttctgcgagcagattcagtacttgaagtgagtcttcccccttatttatttgcttttgtcctttttttttggctttttagaatgattggaagctcattcttttttttttttttttgtcagccaaaatgccgatgtcttcctcggttacactgcgtggtcggctggtgggttcgatcagacatatgagcttgtccagacgccgattaagcagtccgatggcacgtacaaagatactgcactcgcgcagaagtgcactgttggtgcttgggcgaatgcttgagggccgtcacgaattcatgtattgaggtgattcatacgaaagcatgagcctgttgacagctgcgactgtcacctgggatgattgcaatcatttagcacatcattgagtagtctccgaagaatacaaacaatctgaagcgtcaattccagc

SEQ ID NO: 44 - DNA, 1083 bp, M. phaseolina
atgaagaccgctactctcgccgctgcggcgtcccttttcacttccgccgccctcgccgcacccaccagcaccttgaaggctgctgccgcctccaaggtcaagttcgccggcgtcaacattgccggcttcgacttcggctgcggcacagatggaacctgcacacagaccgcatcaaccgccaccgaccccttgaccgactccgacggccagggtcaaatggaccactttgtcaaggacgacaagctcaacgcattccgcctgcccgtcggctggcagtacctggtcgccaacaagctcggcggcgacctagactcggccaacgccggtaaatacgacaatcttgtccaggggtgtctcaagtccggggccgagctctgtatcatcgacatccataactacgcccgctggaacggccagatcatcggccagggtggccccaccaacgaccagttcgtctcgctctggaagcagctggctacaaagtacaaggacaacaccaaggtggcgttcggggtcatgaatgagccccacgacgtgcccgacatcaacaagtgggccgacacggtccagcaggtcgtcaccgccatccgcaatgctggcgcaacgacgcaatacgtgctcctgccgggcaatgactggacgagcgccgcggccttcattgataatggctctgcggcggcgttgaagaaggtgaccaaccccgacggctcgaccgacaacctgatcttcgacgtgcacaagtacctcgacagcgataactcgggcacgcatactgagtgcgtgacaaacaacatcgacgatgcgttcaagccgcttgccgactggttgaggcagaacaagcgcatggcgatcaacacggagagcggtggcggcaacaccgactcttgcgagaaatacttctgcgagcagattcagtacttgaaccaaaatgccgatgtcttcctcggttacactgcgtggtcggctggtgggttcgatcagacatatgagcttgtccagacgccgattaagcagtccgatggcacgtacaaagatactgcactcgcgcagaagtgcactgttggtgcttgggcgaatgcttga

SEQ ID NO: 45 - protein, 360 aa, M. phaseolina
MKTATLAAAASLFTSAALAAPTSTLKAAAASKVKFAGVNIAGFDFGCGTDGTCTQTASTATDPLTDSDGQGQMDHFVKDDKLNAFRLPVGWQYLVANKLGGDLDSANAGKYDNLVQGCLKSGAELCIIDIHNYARWNGQIIGQGGPTNDQFVSLWKQLATKYKDNTKVAFGVMNEPHDVPDINKWADTVQQVVTAIRNAGATTQYVLLPGNDWTSAAAFIDNGSAAALKKVTNPDGSTDNLIFDVHKYLDSDNSGTHTECVTNNIDDAFKPLADWLRQNKRMAINTESGGGNTDSCEKYFCEQIQYLNQNADVFLGYTAWSAGGFDQTYELVQTPIKQSDGTYKDTALAQKCTVGAWANA

SEQ ID NO: 46 - DNA, 1781 bp, M. phaseolina
cggtaggaagcatccccttcttcgtcgacgtagttgtcctctcttcggagtattgtatactcttttcggtcattccttagcctggttgcttcagcacgttctttaaacccgccgaacacagcaaacattttttgattcgccacattcgctatgccatccttcaaatcttcctccatgcaggccatgctggctctggccgcatcggccaccgctcttcccaccttttcctcaatgcagaagcgccaagcctctcaatctcctgccaacctgtgcggcatgcccgatgattcgcttatcctttcgggaacgccctggattgtctacaatatgatgtacaactctgcccagatcgagggcactgcttgcacaggatacgtcggcactaccaccgatgccaatggcaaccaggccgtcaagtggaacagtacctggaacatcgaatacgttcagtccaccgataacgttcccaagggctactctttcgtcggtctgacccagaacctggaaagccgtatcagcgacattggctctattcccaccacctacgagtggactaggaccaacacgacagcttacaagggcaacgtctgctacgacttcatgacctcggataccaagggcgactccaccagctccaatgcccaggagctgatgctctggctgcagtatgatggtggtcagttgcccattggctggaccgccggtgctgttgctaccattgacaacctctacggtacctcctggaagctttaccagggcaagaacgacgacaccggcattactgtcagcagcctgctgcccgacacccagttcgatggctctttcagtggtgacattaaggactggctcgaagctctcgttaagcagggcctcttcactgagagtacatatgtgaatgtcggcaacgcaggaagtagataccccttcgtgatcctaatacttcttcccttactgattgcaaaactctagccgagcccttctacggtgactgcgttcttgacgccaccctcgctctccaggtcaaccttggatccgacaccaccgccgagtctgtgacccccatttcttctgtggtccctacctccactgctgccccatcatctaccgaggttcccgcatccactaaagtgcccgcttccgccgaaacccctccaccatcatcatcatcatcatctacccccgccgcgacgccttcctccagcgctgcgactttcgtcctcccctcctccagcagcaccatcaccgtcgagtccaccgagctccccaccagcactcctcccacaacgctggccagcacgctcgccgccccctcctccgctgccaacggtgccgactcaatcccctcctcctccatcgaggcgcccgcctccaatacaacccttccggccaccccgtcatctcccgccccaactcctgcgataagcactccagccacccccacccccagcgctgctgaccccgtatcccctacaggtaactacggtcctccttctagcttcagcggcttcggcaacgatggccccgcacctactcctggatccggtgtttctggtgaccagggccagagtcccgctcctggggagggtgaagacgacgagggcccttgtgcggtcgagtacatttacgtataagcgcctccatggatgagaaaaatgagatggggagggttgggccttgacggggacgtatagagcgatggaaacaaaaaaaaaaaaaaagagcggtgaattgaaatgggggacaggtgtgggtgtgtctgccagttcctcattcggtccttt

SEQ ID NO: 47 - DNA, 1395 bp, M. phaseolina
atgccatccttcaaatcttcctccatgcaggccatgctggctctggccgcatcggccaccgctcttcccaccttttcctcaatgcagaagcgccaagcctctcaatctcctgccaacctgtgcggcatgcccgatgattcgcttatcctttcgggaacgccctggattgtctacaatatgatgtacaactctgcccagatcgagggcactgcttgcacaggatacgtcggcactaccaccgatgccaatggcaaccaggccgtcaagtggaacagtacctggaacatcgaatacgttcagtccaccgataacgttcccaagggctactctttcgtcggtctgacccagaacctggaaagccgtatcagcgacattggctctattcccaccacctacgagtggactaggaccaacacgacagcttacaagggcaacgtctgctacgacttcatgacctcggataccaagggcgactccaccagctccaatgcccaggagctgatgctctggctgcagtatgatggtggtcagttgcccattggctggaccgccggtgctgttgctaccattgacaacctctacggtacctcctggaagctttaccagggcaagaacgacgacaccggcattactgtcagcagcctgctgcccgacacccagttcgatggctctttcagtggtgacattaaggactggctcgaagctctcgttaagcagggcctcttcactgagaccgagcccttctacggtgactgcgttcttgacgccaccctcgctctccaggtcaaccttggatccgacaccaccgccgagtctgtgacccccatttcttctgtggtccctacctccactgctgccccatcatctaccgaggttcccgcatccactaaagtgcccgcttccgccgaaacccctccaccatcatcatcatcatcatctacccccgccgcgacgccttcctccagcgctgcgactttcgtcctcccctcctccagcagcaccatcaccgtcgagtccaccgagctccccaccagcactcctcccacaacgctggccagcacgctcgccgccccctcctccgctgccaacggtgccgactcaatcccctcctcctccatcgaggcgcccgcctccaatacaacccttccggccaccccgtcatctcccgccccaactcctgcgataagcactccagccacccccacccccagcgctgctgaccccgtatcccctacaggtaactacggtcctccttctagcttcagcggcttcggcaacgatggccccgcacctactcctggatccggtgtttctggtgaccagggccagagtcccgctcctggggagggtgaagacgacgagggcccttgtgcggtcgagtacatttacgtataa

SEQ ID NO: 48 - protein, 464 aa, M. phaseolina
MPSFKSSSMQAMLALAASATALPTFSSMQKRQASQSPANLCGMPDDSLILSGTPWIVYNMMYNSAQIEGTACTGYVGTTTDANGNQAVKWNSTWNIEYVQSTDNVPKGYSFVGLTQNLESRISDIGSIPTTYEWTRTNTTAYKGNVCYDFMTSDTKGDSTSSNAQELMLWLQYDGGQLPIGWTAGAVATIDNLYGTSWKLYQGKNDDTGITVSSLLPDTQFDGSFSGDIKDWLEALVKQGLFTETEPFYGDCVLDATLALQVNLGSDTTAESVTPISSVVPTSTAAPSSTEVPASTKVPASAETPPPSSSSSSTPAATPSSSAATFVLPSSSSTITVESTELPTSTPPTTLASTLAAPSSAANGADSIPSSSIEAPASNTTLPATPSSPAPTPAISTPATPTPSAADPVSPTGNYGPPSSFSGFGNDGPAPTPGSGVSGDQGQSPAPGEGEDDEGPCAVEYIYV

SEQ ID NO: 49 - DNA, 1842 bp, M. phaseolina
atcccgtcctccagcgcctgctgcgagtaatggcccctttcgagaacacttccaccaggaaccagcagctccagcgcgtataaaaccacggatggcgacatccaagtcggccctcatccagcaaccgccttctctccgccatcttgcaccatgctttcccacgcgctgctcgctgctctctccgcctcgctggtcgccggccagcaggtgggcacccagaaggccgaggtttgtttcctgcgccctggcccagccggtgcacagcggccgctgacacaggcacgcaggtccacccccccttgacctggcagagctgcaccaagagcggctgcaccaccaaccagggttccgtggtcatcgacgccaactggcgctgggtccacaacaccggcggctacaccaactgctacaccggtatgtttgcgcccttccatgcacccgccagctcgtgacaggtcccaggcaactcgtggaactcggcctactgcactgacaacgccgcctgcgccgccgcctgcgctctcgatggcgctgactactcgggcacctacggcgccaccaccagcggcaactccctgcgcctgaacttcatcaccaacggcgcgcagaagaacgtcggctcgcgtatgtacctgatgaaggacgacaacacctacgccgtccacaagctcctcaaccaggagttcaccttcgacgtcgacgtctccaagctgccctgcggcctcaacggcgccgtctacttcgtctccatggacgctgacggcggcaaggccaagttcccggccaacaaggccggcgccaagtacggcactggctactgcgacagccagtgcccgcgtgacttgaagttcatcgacggccaggccaacgtcaagggctggaccccgtccgactctgacgtcaactctggcgtcggcaatctcggatcctgctgtgccggtacgtcgctgccatctctctcctttctgcatgtcatgcgccgaacggatgctaaccgcgcgttcagagatggatatctgggaggccaactccatctccaccgcctacaccccccacccgtgcaccaactccgcccagcactcttgccagggcgatgcgtgcggtggcacctactcggccgaccgctacgccggcgactgcgaccccgacggatgcgacttcaactcattccgccaaggcaacaagaccttctacgggcccggcctcaccgtcgacaccaactccaagatcaccgtggtcacgcagttcatcaccaacaccggcaccgcctcgggcacgctcaaggagatcaagcgcttctacgtgcagaacggcaagacgatccccaactcggtgtcgaccatctccggcgtgcccggcaactcggtcaccgactccttctgcaccgcccagaagtccgtcttcggcgacaacaacattttccagaagaggggtggcctggccggcatgtcccaggccctcaacgccggcatggtcctcgtgctctccatctgggatgaccaccacagcaacatgctctggctcgacagcgacttccccaccgacgccgacccggccaagcccggtatttcccgtggaacctgccccaccaccagcggtgaccccgatgacgtcgagtcgtccgccgccaacgcctacgtcgtctactccaacatcaaagttggtgccatcaacagcaccttcactccttaggcgacaggaaagagcatggaaagtcgtagtttgtattgagcgggatgcgaggaggtacgcggccggggttaggagtgtgaaataagagctgggagcactcggcttcgaagcaacatgcttcaacgtctctggattcctgccgcgtgctgg

SEQ ID NO: 50 - DNA, 1368 bp, M. phaseolina
atgctttcccacgcgctgctcgctgctctctccgcctcgctggtcgccggccagcaggtgggcacccagaaggccgaggtccacccccccttgacctggcagagctgcaccaagagcggctgcaccaccaaccagggttccgtggtcatcgacgccaactggcgctgggtccacaacaccggcggctacaccaactgctacaccggcaactcgtggaactcggcctactgcactgacaacgccgcctgcgccgccgcctgcgctctcgatggcgctgactactcgggcacctacggcgccaccaccagcggcaactccctgcgcctgaacttcatcaccaacggcgcgcagaagaacgtcggctcgcgtatgtacctgatgaaggacgacaacacctacgccgtccacaagctcctcaaccaggagttcaccttcgacgtcgacgtctccaagctgccctgcggcctcaacggcgccgtctacttcgtctccatggacgctgacggcggcaaggccaagttcccggccaacaaggccggcgccaagtacggcactggctactgcgacagccagtgcccgcgtgacttgaagttcatcgacggccaggccaacgtcaagggctggaccccgtccgactctgacgtcaactctggcgtcggcaatctcggatcctgctgtgccgagatggatatctgggaggccaactccatctccaccgcctacaccccccacccgtgcaccaactccgcccagcactcttgccagggcgatgcgtgcggtggcacctactcggccgaccgctacgccggcgactgcgaccccgacggatgcgacttcaactcattccgccaaggcaacaagaccttctacgggcccggcctcaccgtcgacaccaactccaagatcaccgtggtcacgcagttcatcaccaacaccggcaccgcctcgggcacgctcaaggagatcaagcgcttctacgtgcagaacggcaagacgatccccaactcggtgtcgaccatctccggcgtgcccggcaactcggtcaccgactccttctgcaccgcccagaagtccgtcttcggcgacaacaacattttccagaagaggggtggcctggccggcatgtcccaggccctcaacgccggcatggtcctcgtgctctccatctgggatgaccaccacagcaacatgctctggctcgacagcgacttccccaccgacgccgacccggccaagcccggtatttcccgtggaacctgccccaccaccagcggtgaccccgatgacgtcgagtcgtccgccgccaacgcctacgtcgtctactccaacatcaaagttggtgccatcaacagcaccttcactccttag

SEQ ID NO: 51 - protein, 455 aa, M. phaseolina
MLSHALLAALSASLVAGQQVGTQKAEVHPPLTWQSCTKSGCTTNQGSVVIDANWRWVHNTGGYTNCYTGNSWNSAYCTDNAACAAACALDGADYSGTYGATTSGNSLRLNFITNGAQKNVGSRMYLMKDDNTYAVHKLLNQEFTFDVDVSKLPCGLNGAVYFVSMDADGGKAKFPANKAGAKYGTGYCDSQCPRDLKFIDGQANVKGWTPSDSDVNSGVGNLGSCCAEMDIWEANSISTAYTPHPCTNSAQHSCQGDACGGTYSADRYAGDCDPDGCDFNSFRQGNKTFYGPGLTVDTNSKITVVTQFITNTGTASGTLKEIKRFYVQNGKTIPNSVSTISGVPGNSVTDSFCTAQKSVFGDNNIFQKRGGLAGMSQALNAGMVLVLSIWDDHHSNMLWLDSDFPTDADPAKPGISRGTCPTTSGDPDDVESSAANAYVVYSNIKVGAINSTFTP

SEQ ID NO: 52 - DNA, 1967 bp, M. phaseolina
gaaacatattcgtttcaatctaatgtactcaagggaggaataacggggacagcggcttgtcgacaaccggctcaagactataagagcccagtgagaccctgctaagttttgctctccagttgccggacaacatcctctcactagcccatcatgtaccagacttccattctttcttctctttccctgcttcttgcggcctccagcgcccagcaggtcggcacgcagaccgccgagacgcaccccaagctcaccacgcaaaagtgcaccaaggccggcggctgcaccgaccaggccacctccatcgttcttgacgccaactggcgctggctccatacgactgagggctacaccaactgctacaccggccaggagtgggacacttccatttgttccgaccccaagacttgcgccactagctgcgctctcgatggcgccgattatgagggaacgtacggtatcacgaccagcggcaacgctcttacgatgaagttcgtcacgcaggggtctcagaagaacgtcggtggccgtgtctacctattggcccctgacagcgacgacacgtacgagctcttcaagctcaagaaccaggagttcacttttgacgttgacgtctcgaacctcccttgcggtctcaatggcgctctctacttctctgaggttcgtaatcttatcgtcaatgcgctgcttgcgttactgacgctctcagatggacgccgatggtggcctgtccaagtacgagaccaacaaggccggtgccaagtatggtactggttactgcgacacccagtgcccgcacgacattaagttcatcaacggcgaggccaacgtccttaactggaccaagtccgagacggatgtcaacgccggttccggtcaatacggttcttgctggtaagtggccttcacatcagggcaacgcccctttttgcaccaacggaacatagaattccgaaacgcccttggaaagctctcgtctatgggtattcgctaatgctgaaaacagctttgagtttgatgtctgggaggcgaactctcaagcaactgctttgaccccccacgtttgcactgctgccgtaagtgttcacttcgtgtccaatagttgccacgaaccattactgatcgtgaaaagaccgttggccaggtccgctgtgagggcgatgactgtggagatggtgacaaccgctacggcggcatctgtgacaaggacggctgtgacttcaacccgtaccgcatgggcaatgagactttctacggcaccaacaacagcgtcatcgacaccaccaagaagttcaccatcgtgacgcagttcagtgggtttcccgacccacggataccgccttaagctccgcaagctgatgaactatacagttacttctgacaacaccgccgacggtgagctcgttgagatccgccgcaagtacgtccaggatggcaaggtcatcgagaactcgttcgccgactacgacaccctctcccagtttaactccatctcggacgacttctgtgacgctcagaagactctctttggcgacaacaatgacttcaagaccaagggtggtctctctgtcatgggtgaatccctcgctcgcggtcaggtccttgttatgtccatctgggacgaccatgctgcgaacgccctctggctcgactctagctaccccaccgacgccgatccgagcaagcctggtgtcaagcgtggtccttgtggcactgatactggcaagcccgacgatgttgaggcccagtaccccgacagcactgttgtctacagcaacatccgctacggtgacatcgactccacctacacttccgcttaaaggggaaatttctgtacgcggatgggcaaatatgaggacaaccgccgggtaactcaaaccaaaaagttccctctacctttactgtttcgtaagatggatctctcaaggctcccttccgcaatcctctctctaccttctatcattctagag

SEQ ID NO: 53 - DNA, 1392 bp, M. phaseolina
atgtaccagacttccattctttcttctctttccctgcttcttgcggcctccagcgcccagcaggtcggcacgcagaccgccgagacgcaccccaagctcaccacgcaaaagtgcaccaaggccggcggctgcaccgaccaggccacctccatcgttcttgacgccaactggcgctggctccatacgactgagggctacaccaactgctacaccggccaggagtgggacacttccatttgttccgaccccaagacttgcgccactagctgcgctctcgatggcgccgattatgagggaacgtacggtatcacgaccagcggcaacgctcttacgatgaagttcgtcacgcaggggtctcagaagaacgtcggtggccgtgtctacctattggcccctgacagcgacgacacgtacgagctcttcaagctcaagaaccaggagttcacttttgacgttgacgtctcgaacctcccttgcggtctcaatggcgctctctacttctctgagatggacgccgatggtggcctgtccaagtacgagaccaacaaggccggtgccaagtatggtactggttactgcgacacccagtgcccgcacgacattaagttcatcaacggcgaggccaacgtccttaactggaccaagtccgagacggatgtcaacgccggttccggtcaatacggttcttgctgctttgagtttgatgtctgggaggcgaactctcaagcaactgctttgaccccccacgtttgcactgctgccaccgttggccaggtccgctgtgagggcgatgactgtggagatggtgacaaccgctacggcggcatctgtgacaaggacggctgtgacttcaacccgtaccgcatgggcaatgagactttctacggcaccaacaacagcgtcatcgacaccaccaagaagttcaccatcgtgacgcagttcattacttctgacaacaccgccgacggtgagctcgttgagatccgccgcaagtacgtccaggatggcaaggtcatcgagaactcgttcgccgactacgacaccctctcccagtttaactccatctcggacgacttctgtgacgctcagaagactctctttggcgacaacaatgacttcaagaccaagggtggtctctctgtcatgggtgaatccctcgctcgcggtcaggtccttgttatgtccatctgggacgaccatgctgcgaacgccctctggctcgactctagctaccccaccgacgccgatccgagcaagcctggtgtcaagcgtggtccttgtggcactgatactggcaagcccgacgatgttgaggcccagtaccccgacagcactgttgtctacagcaacatccgctacggtgacatcgactccacctacacttccgcttaa

SEQ ID NO: 54 - protein, 463 aa, M. phaseolina
MYQTSILSSLSLLLAASSAQQVGTQTAETHPKLTTQKCTKAGGCTDQATSIVLDANWRWLHTTEGYTNCYTGQEWDTSICSDPKTCATSCALDGADYEGTYGITTSGNALTMKFVTQGSQKNVGGRVYLLAPDSDDTYELFKLKNQEFTFDVDVSNLPCGLNGALYFSEMDADGGLSKYETNKAGAKYGTGYCDTQCPHDIKFINGEANVLNWTKSETDVNAGSGQYGSCCFEFDVWEANSQATALTPHVCTAATVGQVRCEGDDCGDGDNRYGGICDKDGCDFNPYRMGNETFYGTNNSVIDTTKKFTIVTQFITSDNTADGELVEIRRKYVQDGKVIENSFADYDTLSQFNSISDDFCDAQKTLFGDNNDFKTKGGLSVMGESLARGQVLVMSIWDDHAANALWLDSSYPTDADPSKPGVKRGPCGTDTGKPDDVEAQYPDSTVVYSNIRYGDIDSTYTSA

SEQ ID NO: 55 - DNA, 886 bp, M. phaseolina
tcacttcgtgtccaatagttgccacgaaccattactgatcgtgaaaagaccgttggccaggtccgctgtgagggcgatgactgtggagatggtgacaaccgctacggcggcatctgtgacaaggacggctgtgacttcaacccgtaccgcatgggcaatgagactttctacggcaccaacaacagcgtcatcgacaccaccaagaagttcaccatcgtgacgcagttcagtgggtttcccgacccacggataccgccttaagctccgcaagctgatgaactatacagttacttctgacaacaccgccgacggtgagctcgttgagatccgccgcaagtacgtccaggatggcaaggtcatcgagaactcgttcgccgactacgacaccctctcccagtttaactccatctcggacgacttctgtgacgctcagaagactctctttggcgacaacaatgacttcaagaccaagggtggtctctctgtcatgggtgaatccctcgctcgcggtcaggtccttgttatgtccatctgggacgaccatgctgcgaacgccctctggctcgactctagctaccccaccgacgccgatccgagcaagcctggtgtcaagcgtggtccttgtggcactgatactggcaagcccgacgatgttgaggcccagtaccccgacagcactgttgtctacagcaacatccgctacggtgacatcgactccacctacacttccgcttaaaggggaaatttctgtacgcggatgggcaaatatgaggacaaccgccgggtaactcaaaccaaaaagttccctctacctttactgtttcgtaagatggatctctcaaggctcccttccgcaatcctctctctaccttctatcattctagag

SEQ ID NO: 56 - DNA, 528 bp, M. phaseolina
atgggcaatgagactttctacggcaccaacaacagcgtcatcgacaccaccaagaagttcaccatcgtgacgcagttcattacttctgacaacaccgccgacggtgagctcgttgagatccgccgcaagtacgtccaggatggcaaggtcatcgagaactcgttcgccgactacgacaccctctcccagtttaactccatctcggacgacttctgtgacgctcagaagactctctttggcgacaacaatgacttcaagaccaagggtggtctctctgtcatgggtgaatccctcgctcgcggtcaggtccttgttatgtccatctgggacgaccatgctgcgaacgccctctggctcgactctagctaccccaccgacgccgatccgagcaagcctggtgtcaagcgtggtccttgtggcactgatactggcaagcccgacgatgttgaggcccagtaccccgacagcactgttgtctacagcaacatccgctacggtgacatcgactccacctacacttccgcttaa

SEQ ID NO: 57 - protein, 175 aa, M. phaseolina
MGNETFYGTNNSVIDTTKKFTIVTQFITSDNTADGELVEIRRKYVQDGKVIENSFADYDTLSQFNSISDDFCDAQKTLFGDNNDFKTKGGLSVMGESLARGQVLVMSIWDDHAANALWLDSSYPTDADPSKPGVKRGPCGTDTGKPDDVEAQYPDSTVVYSNIRYGDIDSTYTSA

SEQ ID NO: 58 - DNA, 2798 bp, M. phaseolina
cgcgtggcatggcaccgggatttctttccaagaccccgagcacgcctgcccgagccgtgcccccgccctggccgtgaataagtagtccgcgagtcctcgctgctgaagagactccaaggcaagcctggacgatactcccgacaagcaacaatggctcctctcaccaacatggccgcgctcctgctcggcgccgtagctggcgccgaggccgctcaggactgggatcactcgctgtacaccaccagcccgcctgtctacccttcgcccaacatgaccggcgtcgactcagcgtcgctgtcgggttgggccggtgctctggagaaggctgaggccctcctcagcaacctgaccctcgaggagaaggtcctcatgctcactggtgctgctggtccttgcgttgggtatgatcgcttttctcttcctcatcacgcactcgcttacagccctgcagaaacatcgcacccatccctcgcgtcggcttcaagggcctctgtctccaggacggtcctctcggcatccgccaggccgactatgccagcgctttccccgctggtctgagtgctgccgcctcctttgacaaggatctcatccatgagcgcggaaagctcattggtgaggagttccgcggcaagggtgctcacatcttccttggccccgtcgctggcccgctcggccgcagcgccatggctggtcgtaactgggagggcttctctcccgatccgtacctcactggtgttgccatggaggagactattctcggtgtccagagcaccggtgtccaggccaacgccaagcactgggtcgcctacgagcaggagacccagcgcaaccccgaggacgctttcgccgcgtcgcacgagccgaacgacaaggagcagatgtccgtctcctccaacgtcgatgaccgcacccttcacgagctttacgtttggcccttcgccaacgcaatccgtgctggtgtttccagcgtcatgtgcgcctaccagcgcatcaacggctcttacgcctgccaaaactccaagacgcagaacggcatcctcaagactgagctcggcttccagggctacgtcatgtccgactggatgggcacccacagcggcgtcgcttccgtcgaggctggtttggacatgacgatgcccggtgcctggaactggcagccgtggctcaactggtctactccctcgtactttggcggcaacctgaccaaggccgtcgaaaacggcaccgtctctgtgacccgtgtcgacgacatggtcaagcgtgtcctgactccttactacctgcttggccaggacgagggcttccccggtgttgacccttctagcggcgcctaccctgcggttaacgacttccagcccgagagcaactggtacgacacctggaaggctgccggtgccctcaacgatgaggtctccgtcaatgttcgtggcaaccacagcgagcacatccgcaagctaggtgccgctggctctgtcctcctgaagaacgtcaacaacacccttcccctcaagagccctaagaagatcgccgtgttcggcaacgctgctggcgacctcaccaacggtctctaccctaaaagcagcgactatgagtacggcactctccccgttggtggtgggtctggtacctcccgcttcacctccgtcgtcgccccgctcgatgctatcaagacgcgcgctaaggccgacggtgccacggtccaatacgtcctgaacaacacgctcctgaccaccgctggttcctacgccagcaaaatctaccccgagcctgacgtctgcctggtcttcgtcaagacatgggcctctgaaggcgaggaccgcgccgacctcaacctcaactgggagggcaacgaggtcatcgaccagattgctgccaattgcagcaacaccgtcgtcatctccaactccggcggcctcactctgatgccctgggccaaccacgagaacgtcaccgccatcctggcggcccacctgcccggcgaggagatcggcaactcgatcgtcgacatcctgtacggcgacgtcaatccctcgggcaagctcccttacaccatcgcccaccaggcctcagactactacttcgcaaacatcaccacctcggtcgccaacaccaccgacaccgacgcctggcagtccgacttcaccgagcgcctcctcatcgactaccgctactttgactatcacaacatctccgttctctacgagttcggattcggcctctcctacaccaccttcgccctcgccgacatctccatctcccctgtttccaactcgtccaccatcgccggcacccccgcccccacgaccgaggtcgtccccggcggcaaccccgccctctgggacacggtctacaaggtcactgccacggttagcaacacgggcgacctcaccggcgccgctgtcccgcagctgtacatcgagctgcccgcctcagccggcgagggcacccccgttaagcagctgcgcggcttcgagaaggtcgagctcgccgccggcgagagccagcaggtcacatttgagctcatgcgtcgtgatctgtcggtttgggacgtcgtttcgcaggagtggagcgtgcccagcggcacttttggcgtgcacgttggcttctcctcgagggatgtgcagctgaaggggcagtttactgtttaacgaagggctaaagtgtatgattttgatgaattaattgtaaaaaggatatgattgggttgagtggaggtgggaaggggaagagagggttatgtgctgtacctactagtgatggtatggcttttaatgataatgcgaatctagtatcatagc

SEQ ID NO: 59 - DNA, 2448 bp, M. phaseolina
atggctcctctcaccaacatggccgcgctcctgctcggcgccgtagctggcgccgaggccgctcaggactgggatcactcgctgtacaccaccagcccgcctgtctacccttcgcccaacatgaccggcgtcgactcagcgtcgctgtcgggttgggccggtgctctggagaaggctgaggccctcctcagcaacctgaccctcgaggagaaggtcctcatgctcactggtgctgctggtccttgcgttggaaacatcgcacccatccctcgcgtcggcttcaagggcctctgtctccaggacggtcctctcggcatccgccaggccgactatgccagcgctttccccgctggtctgagtgctgccgcctcctttgacaaggatctcatccatgagcgcggaaagctcattggtgaggagttccgcggcaagggtgctcacatcttccttggccccgtcgctggcccgctcggccgcagcgccatggctggtcgtaactgggagggcttctctcccgatccgtacctcactggtgttgccatggaggagactattctcggtgtccagagcaccggtgtccaggccaacgccaagcactgggtcgcctacgagcaggagacccagcgcaaccccgaggacgctttcgccgcgtcgcacgagccgaacgacaaggagcagatgtccgtctcctccaacgtcgatgaccgcacccttcacgagctttacgtttggcccttcgccaacgcaatccgtgctggtgtttccagcgtcatgtgcgcctaccagcgcatcaacggctcttacgcctgccaaaactccaagacgcagaacggcatcctcaagactgagctcggcttccagggctacgtcatgtccgactggatgggcacccacagcggcgtcgcttccgtcgaggctggtttggacatgacgatgcccggtgcctggaactggcagccgtggctcaactggtctactccctcgtactttggcggcaacctgaccaaggccgtcgaaaacggcaccgtctctgtgacccgtgtcgacgacatggtcaagcgtgtcctgactccttactacctgcttggccaggacgagggcttccccggtgttgacccttctagcggcgcctaccctgcggttaacgacttccagcccgagagcaactggtacgacacctggaaggctgccggtgccctcaacgatgaggtctccgtcaatgttcgtggcaaccacagcgagcacatccgcaagctaggtgccgctggctctgtcctcctgaagaacgtcaacaacacccttcccctcaagagccctaagaagatcgccgtgttcggcaacgctgctggcgacctcaccaacggtctctaccctaaaagcagcgactatgagtacggcactctccccgttggtggtgggtctggtacctcccgcttcacctccgtcgtcgccccgctcgatgctatcaagacgcgcgctaaggccgacggtgccacggtccaatacgtcctgaacaacacgctcctgaccaccgctggttcctacgccagcaaaatctaccccgagcctgacgtctgcctggtcttcgtcaagacatgggcctctgaaggcgaggaccgcgccgacctcaacctcaactgggagggcaacgaggtcatcgaccagattgctgccaattgcagcaacaccgtcgtcatctccaactccggcggcctcactctgatgccctgggccaaccacgagaacgtcaccgccatcctggcggcccacctgcccggcgaggagatcggcaactcgatcgtcgacatcctgtacggcgacgtcaatccctcgggcaagctcccttacaccatcgcccaccaggcctcagactactacttcgcaaacatcaccacctcggtcgccaacaccaccgacaccgacgcctggcagtccgacttcaccgagcgcctcctcatcgactaccgctactttgactatcacaacatctccgttctctacgagttcggattcggcctctcctacaccaccttcgccctcgccgacatctccatctcccctgtttccaactcgtccaccatcgccggcacccccgcccccacgaccgaggtcgtccccggcggcaaccccgccctctgggacacggtctacaaggtcactgccacggttagcaacacgggcgacctcaccggcgccgctgtcccgcagctgtacatcgagctgcccgcctcagccggcgagggcacccccgttaagcagctgcgcggcttcgagaaggtcgagctcgccgccggcgagagccagcaggtcacatttgagctcatgcgtcgtgatctgtcggtttgggacgtcgtttcgcaggagtggagcgtgcccagcggcacttttggcgtgcacgttggcttctcctcgagggatgtgcagctgaaggggcagtttactgtttaa

SEQ ID NO: 60 - protein, 815 aa, M. phaseolina
MAPLTNMAALLLGAVAGAEAAQDWDHSLYTTSPPVYPSPNMTGVDSASLSGWAGALEKAEALLSNLTLEEKVLMLTGAAGPCVGNIAPIPRVGFKGLCLQDGPLGIRQADYASAFPAGLSAAASFDKDLIHERGKLIGEEFRGKGAHIFLGPVAGPLGRSAMAGRNWEGFSPDPYLTGVAMEETILGVQSTGVQANAKHWVAYEQETQRNPEDAFAASHEPNDKEQMSVSSNVDDRTLHELYVWPFANAIRAGVSSVMCAYQRINGSYACQNSKTQNGILKTELGFQGYVMSDWMGTHSGVASVEAGLDMTMPGAWNWQPWLNWSTPSYFGGNLTKAVENGTVSVTRVDDMVKRVLTPYYLLGQDEGFPGVDPSSGAYPAVNDFQPESNWYDTWKAAGALNDEVSVNVRGNHSEHIRKLGAAGSVLLKNVNNTLPLKSPKKIAVFGNAAGDLTNGLYPKSSDYEYGTLPVGGGSGTSRFTSVVAPLDAIKTRAKADGATVQYVLNNTLLTTAGSYASKIYPEPDVCLVFVKTWASEGEDRADLNLNWEGNEVIDQIAANCSNTVVISNSGGLTLMPWANHENVTAILAAHLPGEEIGNSIVDILYGDVNPSGKLPYTIAHQASDYYFANITTSVANTTDTDAWQSDFTERLLIDYRYFDYHNISVLYEFGFGLSYTTFALADISISPVSNSSTIAGTPAPTTEVVPGGNPALWDTVYKVTATVSNTGDLTGAAVPQLYIELPASAGEGTPVKQLRGFEKVELAAGESQQVTFELMRRDLSVWDVVSQEWSVPSGTFGVHVGFSSRDVQLKGQFTV

SEQ ID NO: 61 - DNA, 3140 bp, M. phaseolina
gagcgtcacggaatgacacggtggggagtgcacggcgacaagcctccccccccaaaccatggctgatacaagaatacgctcgctcgctccaacagcccttccacctgaactcttgcccgctttcttcgttttgatatccttccttccgccatggcccctcccgctgatgttgaggccatcctcgcctcgttgacgttggatgagaaggtcagttgctcagttgctttatttctctccaaaactcctccagcgttcacataacctctacatcctccgccaacccgagtcagagggagccaccaatcagcgaatcaggaatccccagttgaggcgtcgatgcgacggaggctgtgtaacctttcgattcgaagtgtatcgccaaagccgacattcattcgggcttgtcttccgcctcctcactattttgactttccagttcttagggagctccgttgaacaggccatgctgaccagccgcagatctctctcctcgccggcgcaaacttctgggaaaccgtggccatcccctccaagggcatcccctccctgaagaccagcgacggccccaacggtgcccgcggcgccgaatttgcccacggcaccaccgccgcctgcttcccggcgtcggtctgcctggcctcgaccttcgacgtcgacctcgccgcgcaagttggcgcagcgctggccgaggagacgcagagcaagggcgcgcgcgtgctgctggctcccaccgtctgcctgcaccgccatccgctcggcggccgcaacttcgagtccttctccgaggaccccctgcttgccggcaagctggccgcggcgtacatcgccggcttgcaggccaagggcgttggcgcaacgatcaagcacttcgccgcaaacgagcaggagacccagcgctttaccgtcaacgagaccatctcggagcgcgcgctgcgcgagttgtatctcaagcctttcgagattgcgatcaaggaggcgaatccgtgggcggtcatgacgagctacaacctcgtgaatggcacgcatgcggatagcagcgacttcctgctgaagaaggtgctgagaggggattgggggtggaagggactggtcatgagcgattggggtggcacgaactcgactgccgagagcatcaacgccggtatggatctggaaatgccgggccccaccaagtggcgcaaagtcgacgatgtgaaggcggctatcgcggcgggtaagacgagcgaggaggcggtgacggcgagggcgcgcaacgtgctggagctgctggtcaagacgcgtcagtttgaggatccggtcacgccgccggagcaggccatcaacaggccatccacccagaagcttatcaggcaggttggtggatcgggtgcggtgctgctgaagaatgagggggccgtgctgccgattaagaaggagaacttgcggaagaagaggattgcgttgttgggccatgccaaggattcgttgattcatggcggggggagtgcgtctgtcaacgctcattacaaaattactccctacgacggcttgaaggcagctcttggggatgatgtggagctcgtgtacgcaaagggtaggttcaggctcgacttcatcaccgattagccgccagctaatcaatcgcgacaggcgcacacgatttccgtctccttccatccatgggcaagggcgtcaaggactatgaaggatccgccggctggactcttcaacggttcgacaccgaggactacaccaaatcacccgtcggtaccaagaacatacccacgtctcactgggcgcccattctctccacagaagccacggaagcggcaaagctgacaggaacattcactgctgaaacttcgggcaagcactaccttggcttctccggccttgggccgtcgaagctctttatcaacggcgaactggtttcggagcagaagcacaactaccaggacccgatgggcttcctgctaggcggaggcaagcaggaaaacttccagtactacttcgaggcaggcaagcaatacgccatcgaggtgcagtcgcggcggccgcaagtcaacaacagcggtctcagtatcctggacaaatgcatgggcttctacctcggcttcatgacggaagcggagcacgacgaggacatccaaggccaagccgtcgcagctgcgcgcgacgccgacgtggccatcgtgttcaccggccacaccaaggactgggagacggagggccaggaccaggcgagtttccacctgccggctgacggctcgcaggacgcgctcgtcgcggccatcgccgccgccaatgcgaacacggtcgttgtcaacaacaccggcgtcgccgtcgccatgccctggatcgacggggtcgctgccgtcgtccaggcctggttccccggccaggaggccggcaacgccatcgccgacgtgttactgggcaaggtcaacccctcgggccgcttgccgacgagcttcccccgccgcctcgaggatgcgcccgcgcacggcaatttcccgggcgagtacgtggatggccggctggaggtcaggtatgcggaggacgtgttcatcgggtacaggcactacgaccgcgtggataggagtaaggtactgttcccgttcggcttcggcctcagctacacgactttcgcgctgtcgggcttctacgtccagcagaacgaggacgtcgtcgacgtcgctgtcagcgtgcagaatacgggcggtgtggcgggcgcgcaggtggtgcagatttacgcgggcccggagggcaagaggcgcgtcgagtgtccggtgaaacagttggttgggtttaagcgcgttgaggtgcagccgggtgagacgaaggcggtgcaggtaccggtgccggtgaggagcttggcgtactttgaggaggccagggggaagtgggttgtggagaagggcgagtataggatctcggtggcggagtcgtcggttgatgttagggagagtactgttattactgtggagaaggaattggagtttgcgccttgagcgttgtgctgaaggttggggatgtctggacagggggacggaatgtttggtagctgaggagtttgggtgtcggaagggtgctatcgaggtcagattagggtgtgcaagctggctaatggctgaactgtgcggcaggtgattgggtggcga

SEQ ID NO: 62 - DNA, 2511 bp, M. phaseolina
atggcccctcccgctgatgttgaggccatcctcgcctcgttgacgttggatgagaagatctctctcctcgccggcgcaaacttctgggaaaccgtggccatcccctccaagggcatcccctccctgaagaccagcgacggccccaacggtgcccgcggcgccgaatttgcccacggcaccaccgccgcctgcttcccggcgtcggtctgcctggcctcgaccttcgacgtcgacctcgccgcgcaagttggcgcagcgctggccgaggagacgcagagcaagggcgcgcgcgtgctgctggctcccaccgtctgcctgcaccgccatccgctcggcggccgcaacttcgagtccttctccgaggaccccctgcttgccggcaagctggccgcggcgtacatcgccggcttgcaggccaagggcgttggcgcaacgatcaagcacttcgccgcaaacgagcaggagacccagcgctttaccgtcaacgagaccatctcggagcgcgcgctgcgcgagttgtatctcaagcctttcgagattgcgatcaaggaggcgaatccgtgggcggtcatgacgagctacaacctcgtgaatggcacgcatgcggatagcagcgacttcctgctgaagaaggtgctgagaggggattgggggtggaagggactggtcatgagcgattggggtggcacgaactcgactgccgagagcatcaacgccggtatggatctggaaatgccgggccccaccaagtggcgcaaagtcgacgatgtgaaggcggctatcgcggcgggtaagacgagcgaggaggcggtgacggcgagggcgcgcaacgtgctggagctgctggtcaagacgcgtcagtttgaggatccggtcacgccgccggagcaggccatcaacaggccatccacccagaagcttatcaggcaggttggtggatcgggtgcggtgctgctgaagaatgagggggccgtgctgccgattaagaaggagaacttgcggaagaagaggattgcgttgttgggccatgccaaggattcgttgattcatggcggggggagtgcgtctgtcaacgctcattacaaaattactccctacgacggcttgaaggcagctcttggggatgatgtggagctcgtgtacgcaaagggcgcacacgatttccgtctccttccatccatgggcaagggcgtcaaggactatgaaggatccgccggctggactcttcaacggttcgacaccgaggactacaccaaatcacccgtcggtaccaagaacatacccacgtctcactgggcgcccattctctccacagaagccacggaagcggcaaagctgacaggaacattcactgctgaaacttcgggcaagcactaccttggcttctccggccttgggccgtcgaagctctttatcaacggcgaactggtttcggagcagaagcacaactaccaggacccgatgggcttcctgctaggcggaggcaagcaggaaaacttccagtactacttcgaggcaggcaagcaatacgccatcgaggtgcagtcgcggcggccgcaagtcaacaacagcggtctcagtatcctggacaaatgcatgggcttctacctcggcttcatgacggaagcggagcacgacgaggacatccaaggccaagccgtcgcagctgcgcgcgacgccgacgtggccatcgtgttcaccggccacaccaaggactgggagacggagggccaggaccaggcgagtttccacctgccggctgacggctcgcaggacgcgctcgtcgcggccatcgccgccgccaatgcgaacacggtcgttgtcaacaacaccggcgtcgccgtcgccatgccctggatcgacggggtcgctgccgtcgtccaggcctggttccccggccaggaggccggcaacgccatcgccgacgtgttactgggcaaggtcaacccctcgggccgcttgccgacgagcttcccccgccgcctcgaggatgcgcccgcgcacggcaatttcccgggcgagtacgtggatggccggctggaggtcaggtatgcggaggacgtgttcatcgggtacaggcactacgaccgcgtggataggagtaaggtactgttcccgttcggcttcggcctcagctacacgactttcgcgctgtcgggcttctacgtccagcagaacgaggacgtcgtcgacgtcgctgtcagcgtgcagaatacgggcggtgtggcgggcgcgcaggtggtgcagatttacgcgggcccggagggcaagaggcgcgtcgagtgtccggtgaaacagttggttgggtttaagcgcgttgaggtgcagccgggtgagacgaaggcggtgcaggtaccggtgccggtgaggagcttggcgtactttgaggaggccagggggaagtgggttgtggagaagggcgagtataggatctcggtggcggagtcgtcggttgatgttagggagagtactgttattactgtggagaaggaattggagtttgcgccttga

SEQ ID NO: 63 - protein, 836 aa, M. phaseolina
MAPPADVEAILASLTLDEKISLLAGANFWETVAIPSKGIPSLKTSDGPNGARGAEFAHGTTAACFPASVCLASTFDVDLAAQVGAALAEETQSKGARVLLAPTVCLHRHPLGGRNFESFSEDPLLAGKLAAAYIAGLQAKGVGATIKHFAANEQETQRFTVNETISERALRELYLKPFEIAIKEANPWAVMTSYNLVNGTHADSSDFLLKKVLRGDWGWKGLVMSDWGGTNSTAESINAGMDLEMPGPTKWRKVDDVKAAIAAGKTSEEAVTARARNVLELLVKTRQFEDPVTPPEQAINRPSTQKLIRQVGGSGAVLLKNEGAVLPIKKENLRKKRIALLGHAKDSLIHGGGSASVNAHYKITPYDGLKAALGDDVELVYAKGAHDFRLLPSMGKGVKDYEGSAGWTLQRFDTEDYTKSPVGTKNIPTSHWAPILSTEATEAAKLTGTFTAETSGKHYLGFSGLGPSKLFINGELVSEQKHNYQDPMGFLLGGGKQENFQYYFEAGKQYAIEVQSRRPQVNNSGLSILDKCMGFYLGFMTEAEHDEDIQGQAVAAARDADVAIVFTGHTKDWETEGQDQASFHLPADGSQDALVAAIAAANANTVVVNNTGVAVAMPWIDGVAAVVQAWFPGQEAGNAIADVLLGKVNPSGRLPTSFPRRLEDAPAHGNFPGEYVDGRLEVRYAEDVFIGYRHYDRVDRSKVLFPFGFGLSYTTFALSGFYVQQNEDVVDVAVSVQNTGGVAGAQVVQIYAGPEGKRRVECPVKQLVGFKRVEVQPGETKAVQVPVPVRSLAYFEEARGKWVVEKGEYRISVAESSVDVRESTVITVEKELEFAP

SEQ ID NO: 64 - DNA, 2696 bp, M. phaseolina
tggtctggttcatctttgctaggccatgccgcggggttcatcctccggcgtcggcacagtgccacccaaattgttttataaacatcgtgtgagacctcgtcctgtgccggtcgttacggttcatcgtagttgttcaattccaaaggagcaatggttaactcatactccttgctcctagccattgccgcctttggcactgctactccagtccgcagacagggtgagctattttctttcttgccttcccatacgacacccttctgacgcgataaatcagccgctggtgactgggatgctgcgtatgctcaagcagaggcttctcttgcgcaattgaaccaagatgagaaagtcgggatagtcacaggagtcggatggcagaatgggccctgcgttggaaatacctcgcccgtaccgaagatcggttatccttctctctgtctgcaggatggccccctcggaatcagatttgcgcaaggagttactgcgttcccagctggcgtccatgcagcttcgacttgggacaagagcttgatccacgagagaggcgttgccatgggagcagaggccaaaggcttgggcattcacgtacaacttggtcccgtagctggacctcttggcaaggtgcgtctcatcctcactgacttctatcgtagttggtgctcactgttgttagattccacaaggaggccgtaactgggaaggcttttctcctgacccataccttaccggtattgccatgcatgagaccattaccggcatgcagtcctcgggcgtacaagcctgtgctaagcactacattggcaacgaacaagaactcaaccgcaacaccatgtcttccaacattgacgaccgtaccatgcacgagctctacctctggcccttcgccgatgccgtcaaagccaacgtcgccaactttatgtgctcgtacaataagcttgatggtgtctgggcatgcgaaaatgaccacattctcaacagccttctcaaagaggagctcgaattccgcggctacgtcctcagcgattggaatgcgcaacactcgacggtgctcagcgcgaactccggcctggacatgacgatgccaggcgacgactttgccggcggaagcatctattggggacccaacctcactgctgccatcgccgctggccaagtcccacagtcccgcctcgatgatatggtcaagcgcatcctggccgcctggtacctcctcggccaggacgaaggttaccccccaactcttttctcttcctggaacggcggcactggtggccctgacgtgcaggccgaccacaagaacgtcgcccgtgctattgcccgtgatggcaccatcctcctgaagaacgacaatgccactctccccctaaaagcccctgcctccctcgcaatcatcggccaggacgccatcgtcaatccagccggccccaacgcctgcgccgaccgcgcttgcaatactggccacctcgccatgggctgggggtccggcaccaccgaattcccctacctaattgcgcccctcgacgccatccgcccccgcgctgaagcagcaggcacgactctgaccctctccacaaccgacgaccaagccagcgccgcctcagccgctgcggccgccgagacggccatcgtcttcatcacggccgactcgggtgaggagtacctcaccgtcgagggcaatgcgggcgaccgcctcaacctcgacccgtggcacgacggcaacggcctcgtccgcgccgccgcctccgccggtaagcccgtcattgtcgtcgcgcacagcgtcggccccatcatcctcgaggatattctcagccatgacaacgtcgtcgccgtcgtctggggcggcattgccggccaggagagcggcaatggcctcgctgatgtgctgtatggcgacgtcagtccgagtgggaagctgccgtatacgattgctaaggcggcgggtgattatgggacacagctggagcctggtgacgacaacttcgaggagggcttgtatatcgattatcggcatttcgataaggcgggtatcgagccaagatatgagtttgggtttgggttgtgtgagttttgccccttttctccctctcccctctccctctcaccccttgagaaataatcggtgaccgactgaccgatgaccaccagcgtacacgaacttcacctacaccgacctcgtcgccaccgccacgggcggcccttcctacggcgcggcttccgcagcagcgacggacccctacgccccgctcgccaccgtcacggtgaccatcaccaacagcggcgacgtcgctggcgccgaggtcgcgcagctgtacctctcgctgcccgcgtcggccggcgtcgacgccccgctgcgccagctgcgcggcttcgagaagctcgacctcgcgccgggcgagagtggcacggtcgagttcgtgctccgccgcaaggacgctagctactgggatgtggcggcgcagcagtgggtgctgccggccggtgagttcgcgattgcggtgggtgcaagctcgagggatttgagattgcaggggtcgttgactgtttgagctgggtagggagacgggtcggggttgcgcggagaaggaactgtagatttgagatcgttacgacatgatttgagatgcgtgtataagagggaacagaaaagagaaatagcaagagaacattcgctacgtccaaccaccttgattctcccc

SEQ ID NO: 65 - DNA, 2202 bp, M. phaseolina
atggttaactcatactccttgctcctagccattgccgcctttggcactgctactccagtccgcagacaggccgctggtgactgggatgctgcgtatgctcaagcagaggcttctcttgcgcaattgaaccaagatgagaaagtcgggatagtcacaggagtcggatggcagaatgggccctgcgttggaaatacctcgcccgtaccgaagatcggttatccttctctctgtctgcaggatggccccctcggaatcagatttgcgcaaggagttactgcgttcccagctggcgtccatgcagcttcgacttgggacaagagcttgatccacgagagaggcgttgccatgggagcagaggccaaaggcttgggcattcacgtacaacttggtcccgtagctggacctcttggcaagattccacaaggaggccgtaactgggaaggcttttctcctgacccataccttaccggtattgccatgcatgagaccattaccggcatgcagtcctcgggcgtacaagcctgtgctaagcactacattggcaacgaacaagaactcaaccgcaacaccatgtcttccaacattgacgaccgtaccatgcacgagctctacctctggcccttcgccgatgccgtcaaagccaacgtcgccaactttatgtgctcgtacaataagcttgatggtgtctgggcatgcgaaaatgaccacattctcaacagccttctcaaagaggagctcgaattccgcggctacgtcctcagcgattggaatgcgcaacactcgacggtgctcagcgcgaactccggcctggacatgacgatgccaggcgacgactttgccggcggaagcatctattggggacccaacctcactgctgccatcgccgctggccaagtcccacagtcccgcctcgatgatatggtcaagcgcatcctggccgcctggtacctcctcggccaggacgaaggttaccccccaactcttttctcttcctggaacggcggcactggtggccctgacgtgcaggccgaccacaagaacgtcgcccgtgctattgcccgtgatggcaccatcctcctgaagaacgacaatgccactctccccctaaaagcccctgcctccctcgcaatcatcggccaggacgccatcgtcaatccagccggccccaacgcctgcgccgaccgcgcttgcaatactggccacctcgccatgggctgggggtccggcaccaccgaattcccctacctaattgcgcccctcgacgccatccgcccccgcgctgaagcagcaggcacgactctgaccctctccacaaccgacgaccaagccagcgccgcctcagccgctgcggccgccgagacggccatcgtcttcatcacggccgactcgggtgaggagtacctcaccgtcgagggcaatgcgggcgaccgcctcaacctcgacccgtggcacgacggcaacggcctcgtccgcgccgccgcctccgccggtaagcccgtcattgtcgtcgcgcacagcgtcggccccatcatcctcgaggatattctcagccatgacaacgtcgtcgccgtcgtctggggcggcattgccggccaggagagcggcaatggcctcgctgatgtgctgtatggcgacgtcagtccgagtgggaagctgccgtatacgattgctaaggcggcgggtgattatgggacacagctggagcctggtgacgacaacttcgaggagggcttgtatatcgattatcggcatttcgataaggcgggtatcgagccaagatatgagtttgggtttgggttgtcgtacacgaacttcacctacaccgacctcgtcgccaccgccacgggcggcccttcctacggcgcggcttccgcagcagcgacggacccctacgccccgctcgccaccgtcacggtgaccatcaccaacagcggcgacgtcgctggcgccgaggtcgcgcagctgtacctctcgctgcccgcgtcggccggcgtcgacgccccgctgcgccagctgcgcggcttcgagaagctcgacctcgcgccgggcgagagtggcacggtcgagttcgtgctccgccgcaaggacgctagctactgggatgtggcggcgcagcagtgggtgctgccggccggtgagttcgcgattgcggtgggtgcaagctcgagggatttgagattgcaggggtcgttgactgtttga

SEQ ID NO: 66 - protein, 733 aa, M. phaseolina
MVNSYSLLLAIAAFGTATPVRRQAAGDWDAAYAQAEASLAQLNQDEKVGIVTGVGWQNGPCVGNTSPVPKIGYPSLCLQDGPLGIRFAQGVTAFPAGVHAASTWDKSLIHERGVAMGAEAKGLGIHVQLGPVAGPLGKIPQGGRNWEGFSPDPYLTGIAMHETITGMQSSGVQACAKHYIGNEQELNRNTMSSNIDDRTMHELYLWPFADAVKANVANFMCSYNKLDGVWACENDHILNSLLKEELEFRGYVLSDWNAQHSTVLSANSGLDMTMPGDDFAGGSIYWGPNLTAAIAAGQVPQSRLDDMVKRILAAWYLLGQDEGYPPTLFSSWNGGTGGPDVQADHKNVARAIARDGTILLKNDNATLPLKAPASLAIIGQDAIVNPAGPNACADRACNTGHLAMGWGSGTTEFPYLIAPLDAIRPRAEAAGTTLTLSTTDDQASAASAAAAAETAIVFITADSGEEYLTVEGNAGDRLNLDPWHDGNGLVRAAASAGKPVIVVAHSVGPIILEDILSHDNVVAVVWGGIAGQESGNGLADVLYGDVSPSGKLPYTIAKAAGDYGTQLEPGDDNFEEGLYIDYRHFDKAGIEPRYEFGFGLSYTNFTYTDLVATATGGPSYGAASAAATDPYAPLATVTVTITNSGDVAGAEVAQLYLSLPASAGVDAPLRQLRGFEKLDLAPGESGTVEFVLRRKDASYWDVAAQQWVLPAGEFAIAVGASSRDLRLQGSLTV

SEQ ID NO: 67 - DNA, 3114 bp, M. phaseolina
tctgttcatgccaccgtgctcttagccatgtctgtctccctgctttgcgcagcgtctgcgcagcctctctttctgtctctactatccgctcctttatttgcgagaagagcgtctgctcaagacttgcctaatgacccccgctttgaattcatgtccgctgctgccgcggacaatcaaacaacaccatcgacgagactagctgtgccggatggatatgttgctgctcccgcctatcctgcgccttatggcggctgggttgaagaatggagcgccagttacgctaaggccgccgagctcgtctcccagatgacgctcgctgaaaagacgaacattacgtaagtcactattcccggccacgcttccgcggatttccaaactgacggagagtcctgttcagcactggaactgggtactttatgggtacgtttaattcttaaatgccccccaacggccgatttgctaatccaaccccgcacaggcaggtgtgtgggcaacactggcagcgcccttcgtctgggcttcccgcaattgtgtttgcaggactcagcccttggggtcaaggggactgacaacgtcaccgccttccctcctggtatcaccgttggtgctacctggaacaaggacttgatgtatgcccgcggcgtagccatcggccaagaattccgcggcaagggcgtgaacatctaccttggtcctactgtcggccccctgggacgcaagcctcgtggaggccgtaactgggaaggcttcggggccgatcccgtactgcaagctgttggtggcgccttgactatccaggccgtgcaagagcagggtgtgatggccaccatcaagcacttcattggcaatgagcaggagtcctaccgcatgtaagaaatgcactcccgctattatcctcgagcgctgttttcctgactaccccgccaggtacaaccccttccagcccggcatcagctccaacattgatgaccggaccatgcacgaactgtacctgtggccctttgcggagggcatccgcgcaggcgtgacttccgtcatgactgcttacaacgccgtaagtctttcgtcgtcaatcaaggcacccctcctgactctcggcaggtcaacggctccgcatgcgcgcaaaacagctacaatatcaaccacctcctaaaggacgagctcggcttccagggcttcaccatgagcgactggctctcccagatttcgggcgcggcctccgccctcgccggcctggacatgacgatgccgggagaccccacggtgcccctcttcggcgacgcatggtgggcgttccacctgaccgaggcggcgctcaacggctccgtgccaatggaccgcatcgacgacatgacgacgcgaatcgtggcggcctggtaccagatgggccaggaccaggagtacccggaccccaacttctcgacctggacgacggacgcgaccggcctcctttacccgggcgccctcttctccccctccggcgtcgtcaacgagttcgtcaacgtgcaggccgaccacgctgcggtcgcgcgcaccgtctcgatggaagccgtcaccctgctcaagaacgagaacggcacgctgccgctcagcgagagcacgccgctcaaggtcttcggcagcgcggcggaagagaacccggatggcatcaactcgtgctcggacaagtcgtgcaacaagggcacgctcggcatgggctgggggtccggcacggccaactacccgtacatcgactcgccgatcgaagcgctgacgcggcgcgcccagaacgtcacctcctacctgaccgacagcttcccgtcgaatgccgtggtcgctgacggcgacgtcgcgctcgtcttcatcacgtccgactcgggcgagaactacctgagcgtcgagggcaacccgggcgaccgcacggcgtccgggctcaacgcgtggcacaacggtgataaactcgtccaagacgccgccgctaaatacgacacggttgtcgtgatcgtccagaccgtcggccccatcctgctggaggagtggatcgacctgccgtctgtcaaggccgtcctcttccagcacctccccggccaagaggccggcgaatcgctcaccagcgtcctcttcggcgacgagtcgcccagcggacacctgccgtacagcatcccgcgcgccgaggacgatctccccgcgagcgtcggcatcgtgggctttgagctcgggcagccgcaggacaccttctccgaagggctgtacatcgactaccgctacctgaacgcgcacaacaccacgccgcgctaccccttcggccacggcctctcctatacgaccttcaactactccgcgaccatcacgcccggcatcgccctgaccagctcgcctcccgcgcgcccccccaagggcgccacgccggcctacaacaccaccatccccgaccccgccgaggccgtcggcccgcccgccggcttcgacaagatctggcgctacatctactcgtggctgagcgagtccgacgccgaggctgcctatgccaagcgcaacaccacaacctacccctacccggaaggctacagcgagacccagacgcccggcgtccccgcgggcggcgcgcagggcggcaatccggcgctgtgggacacggccttcaacgttaccgccaccatcaccaacaccggcgtcgccccgggcaaggccgtcgcgcaggcgtacgtgcagttcccgagcggcatcgcgtgggacacgcccgtgatccagctaagggatttcgccaagacggggacgctgcagccgggcgagagcgccgaggtggtgttgacgattacgcgcaaggatctgagcgtgtgggatgtcgtgagccagaactgggttgttcctgatgtggagggcgagtataggatttgggttggcgagagctcggggacgttggaattggcgtgctcgacgacgggtttggagtgtgagagcgggctggagagtccggttgcgtgatgagggattgtgcggagagcattgatgacgatgttaagggcgttaatgtggatgatgggctatatctgcgaaaatcctacctcttagcgttggaacccaaccggccgtccgaagccttttcctccgggaatgttcttggtcctcttggta

SEQ ID NO: 68 - DNA, 2712 bp, M. phaseolina
atgtctgtctccctgctttgcgcagcgtctgcgcagcctctctttctgtctctactatccgctcctttatttgcgagaagagcgtctgctcaagacttgcctaatgacccccgctttgaattcatgtccgctgctgccgcggacaatcaaacaacaccatcgacgagactagctgtgccggatggatatgttgctgctcccgcctatcctgcgccttatggcggctgggttgaagaatggagcgccagttacgctaaggccgccgagctcgtctcccagatgacgctcgctgaaaagacgaacattaccactggaactgggtactttatgggcaggtgtgtgggcaacactggcagcgcccttcgtctgggcttcccgcaattgtgtttgcaggactcagcccttggggtcaaggggactgacaacgtcaccgccttccctcctggtatcaccgttggtgctacctggaacaaggacttgatgtatgcccgcggcgtagccatcggccaagaattccgcggcaagggcgtgaacatctaccttggtcctactgtcggccccctgggacgcaagcctcgtggaggccgtaactgggaaggcttcggggccgatcccgtactgcaagctgttggtggcgccttgactatccaggccgtgcaagagcagggtgtgatggccaccatcaagcacttcattggcaatgagcaggagtcctaccgcatgtacaaccccttccagcccggcatcagctccaacattgatgaccggaccatgcacgaactgtacctgtggccctttgcggagggcatccgcgcaggcgtgacttccgtcatgactgcttacaacgccgtcaacggctccgcatgcgcgcaaaacagctacaatatcaaccacctcctaaaggacgagctcggcttccagggcttcaccatgagcgactggctctcccagatttcgggcgcggcctccgccctcgccggcctggacatgacgatgccgggagaccccacggtgcccctcttcggcgacgcatggtgggcgttccacctgaccgaggcggcgctcaacggctccgtgccaatggaccgcatcgacgacatgacgacgcgaatcgtggcggcctggtaccagatgggccaggaccaggagtacccggaccccaacttctcgacctggacgacggacgcgaccggcctcctttacccgggcgccctcttctccccctccggcgtcgtcaacgagttcgtcaacgtgcaggccgaccacgctgcggtcgcgcgcaccgtctcgatggaagccgtcaccctgctcaagaacgagaacggcacgctgccgctcagcgagagcacgccgctcaaggtcttcggcagcgcggcggaagagaacccggatggcatcaactcgtgctcggacaagtcgtgcaacaagggcacgctcggcatgggctgggggtccggcacggccaactacccgtacatcgactcgccgatcgaagcgctgacgcggcgcgcccagaacgtcacctcctacctgaccgacagcttcccgtcgaatgccgtggtcgctgacggcgacgtcgcgctcgtcttcatcacgtccgactcgggcgagaactacctgagcgtcgagggcaacccgggcgaccgcacggcgtccgggctcaacgcgtggcacaacggtgataaactcgtccaagacgccgccgctaaatacgacacggttgtcgtgatcgtccagaccgtcggccccatcctgctggaggagtggatcgacctgccgtctgtcaaggccgtcctcttccagcacctccccggccaagaggccggcgaatcgctcaccagcgtcctcttcggcgacgagtcgcccagcggacacctgccgtacagcatcccgcgcgccgaggacgatctccccgcgagcgtcggcatcgtgggctttgagctcgggcagccgcaggacaccttctccgaagggctgtacatcgactaccgctacctgaacgcgcacaacaccacgccgcgctaccccttcggccacggcctctcctatacgaccttcaactactccgcgaccatcacgcccggcatcgccctgaccagctcgcctcccgcgcgcccccccaagggcgccacgccggcctacaacaccaccatccccgaccccgccgaggccgtcggcccgcccgccggcttcgacaagatctggcgctacatctactcgtggctgagcgagtccgacgccgaggctgcctatgccaagcgcaacaccacaacctacccctacccggaaggctacagcgagacccagacgcccggcgtccccgcgggcggcgcgcagggcggcaatccggcgctgtgggacacggccttcaacgttaccgccaccatcaccaacaccggcgtcgccccgggcaaggccgtcgcgcaggcgtacgtgcagttcccgagcggcatcgcgtgggacacgcccgtgatccagctaagggatttcgccaagacggggacgctgcagccgggcgagagcgccgaggtggtgttgacgattacgcgcaaggatctgagcgtgtgggatgtcgtgagccagaactgggttgttcctgatgtggagggcgagtataggatttgggttggcgagagctcggggacgttggaattggcgtgctcgacgacgggtttggagtgtgagagcgggctggagagtccggttgcgtga

SEQ ID NO: 69 - protein, 903 aa, M. phaseolina
MSVSLLCAASAQPLFLSLLSAPLFARRASAQDLPNDPRFEFMSAAAADNQTTPSTRLAVPDGYVAAPAYPAPYGGWVEEWSASYAKAAELVSQMTLAEKTNITTGTGYFMGRCVGNTGSALRLGFPQLCLQDSALGVKGTDNVTAFPPGITVGATWNKDLMYARGVAIGQEFRGKGVNIYLGPTVGPLGRKPRGGRNWEGFGADPVLQAVGGALTIQAVQEQGVMATIKHFIGNEQESYRMYNPFQPGISSNIDDRTMHELYLWPFAEGIRAGVTSVMTAYNAVNGSACAQNSYNINHLLKDELGFQGFTMSDWLSQISGAASALAGLDMTMPGDPTVPLFGDAWWAFHLTEAALNGSVPMDRIDDMTTRIVAAWYQMGQDQEYPDPNFSTWTTDATGLLYPGALFSPSGVVNEFVNVQADHAAVARTVSMEAVTLLKNENGTLPLSESTPLKVFGSAAEENPDGINSCSDKSCNKGTLGMGWGSGTANYPYIDSPIEALTRRAQNVTSYLTDSFPSNAVVADGDVALVFITSDSGENYLSVEGNPGDRTASGLNAWHNGDKLVQDAAAKYDTVVVIVQTVGPILLEEWIDLPSVKAVLFQHLPGQEAGESLTSVLFGDESPSGHLPYSIPRAEDDLPASVGIVGFELGQPQDTFSEGLYIDYRYLNAHNTTPRYPFGHGLSYTTFNYSATITPGIALTSSPPARPPKGATPAYNTTIPDPAEAVGPPAGFDKIWRYIYSWLSESDAEAAYAKRNTTTYPYPEGYSETQTPGVPAGGAQGGNPALWDTAFNVTATITNTGVAPGKAVAQAYVQFPSGIAWDTPVIQLRDFAKTGTLQPGESAEVVLTITRKDLSVWDVVSQNWVVPDVEGEYRIWVGESSGTLELACSTTGLECESGLESPVA

SEQ ID NO: 70 - DNA, 3549 bp, M. phaseolina
gaaattccacatttaccacttctcagcttctccctctcactgctctctcccgcccttgcgcagatgccgagcgcctccttgcctcctcacgccgcccacgcgtgagacagaaaccacccaattccactaatcgtaataccttgaagtactatgcccgacgactacgagctccgcggcaagtattccgccgtcgacagccagccccaccgccgcaatgcttccagcaacagcaacctgcgcccctcgctcgacgccgcctacctctcctccgacgacgaccaagatcttgacgagttcgacccgctgaacgagcagagcaccccgctcgacacccacaaagctcgccgccgcctccgctccgaatcccaagtcggcgccggcgccgacgcctacacccacgatcgatggcgcaaccagcaccgccggccatgggcgcgcctcgcctccaccttcatgcccgcccgcaaacgcctgtggtgctggctgcccctcctcttcatcctcgccctcctcctgctcctcggtgccggcgggctgtgggcctggcgatccagcccgctcgacggccagagcccgccgtggtacccgtcgccgcgcggtggtgcggaccccaaatgggcggaggcatacagccgggcggcggcgctggtcggcaacatgacgctggtggagaaggtcaacgtcacgactggcgtgggctggtcgatggggctctgcgtgggcaacaccgggccggtcccgcgcctgggctttccgagtctttgcctgcaggatgggccgctgggcttgcgcttcgctgaccacgcgaccgcgtggcccgccggcctcaccgtcggcgccacctggagcaaggagctgatgtacctgcgcggtcaggcgcacgcgcgcgaggccaagggcaaaggcgtcaacgtcctgctcggtcccgcaatgggcccgctgggcaggctgcccgcaggcggtcgcaattgggaaggcttcggcgcggacccggtgctgcagggcctcgcggccgcgtggacgatcaaggggattcaagacgagggcgttatggcgacggcgaagcactacgtcggcaacgagcaggagcatttccgccaggcttgggaatggggcgcccccaacgccatctcctcgaacatcgatgaccgtacgctgcacgagatctacgcatggccattcgcggacagcgtgcgcatcggcgttgcgagcatcatgtgctcttacaaccaggtcaacaactcttatgcctgccagaacagcaagctgctcaatggcgtgctgaaggacgagctcggcttccagggattcgtgcagtcggactggctggcgcagcgcagcggcgttgcgagcgcgctagccgggctggacatgagtatgcccggggatggcctccggtggcaggacggcaagtcgttgtggggtccggagctgaccagggccgctttgaacacctcggtgcccatggaacgcctgaatgatatggccacgcggatcgtggccgcctggtaccagcttggccaggacgatccggagaagtggccggaaaatgggcctaacttttcctcctggacgggcgagaagatcggcttgttgcaccctggcagtgacgaccggactacgggcgaggtcaacaagtttgtcgacgtgcagggcaatggcacgcatggaaagcttgctcgcaggatcgccgctgagggaatcgtgctggtcaaaaatgtgaacgatacgctgcctatttcgcgtcaaggccacagcattgtgagcggcttcatctctaacaaggatgactttaaaatgcacgtcggtgtgtatggcgaggatgcgcgcggaaatccggagggccctaatgcctgtgtcgaccgcgggtgcaatgaaggcactctggcttctgggtgggggagtggcgccgtcgagttcccctatctcatcactcctcaggaagctcttaggcgtgagttcgacagcgatatggtgctgctgcacgagtatcctgcgaatgagatcccggagacgaaacagcgtgcgcttgaagagcaggatctctgccttgtgttcgtcaacagcgatgctggtgaaggcttcattgcttgggaaggtgtcaagggtgacaggaatgatctctacacgcagaaaggcggtgataagctagttgagactgtcgcaaaacgatgcggtggcggtgagagcccagtcattgtcgttgtacatgcagttggccccgttattctcgagaactggattgatatcccgaatgtcaagtctgttctgctcgcacacttgcccggtcaggagagcggaaatgcggttgcagacgttatctttggagacacaaatcccagtggccgactcccgtacacagttgcgaaacatgcggacgactatggcccggatagccatgtcatgtactatcccaatggtgtcgttccgcagcagaacttcactgaaggcctgtatatcgactaccgctacttcgataagaacggaatcacccctcggtacgagtttggctacggcctctcttacagcaagttcgagctctcacaactcgagataacggttgatcccaccaagaagactctcctcccagctccgcgccctgactccaagactctccctgctcctcccgatttcgacaacactgttcctccagctaaggaagcactcttccccgatggtttccgtcgtctgaagaagtacatctatccgtacctcaccagcctctccggaaccgacccagcgccctacaaagcgtatccggaagcttacaccaacaaaaaaaagcatgagaagccctcggaagccggcggcgggcccggtggtaacccggacttgtatacgtatgtcgctaacgtgtcgttcaccgttaaaaacctaagtcccgtccgtggccaggcggtgccgcagctgtatatctcgtacccagaaagctggacggacccggatttcccgctcgtatggggtcagggctacacgaaagaaggctcttcgactgactccgacaaggacaatgacaaattgaagcagcactccgaaggcatcatctccgacaacggcactattgcctcgcctttcttgactatcaacaccagcaaccctcatgctaatgagacggagcacgtccgtccggattggttcgacccccagatggtcgggcagctcagcgtcatcgatttccccgtccgcgtcctgagaggctgggagaaggtcgacctcgcgccggcgggcgagccgggcgattttgtgagagtgagtatcgcgattacgaggaaggatctgagctattgggatgttcggcggcagaattgggtcatgcccacggtcgggggtggcacgagggagtttggggtttggattgggtggagctcgagggacttggttttgagtgggatgatttgagggggctgtatgtaggagggcatcgagagaggtggtgcatctactgggaagtgactgtcttgcatttactggatcggggggtggcgttcctgtggcgtaatttccttttttagctttccccctcacttgcaaagtgtctggtttgccccc

SEQ ID NO: 71 - DNA, 3249 bp, M. phaseolina
atgcccgacgactacgagctccgcggcaagtattccgccgtcgacagccagccccaccgccgcaatgcttccagcaacagcaacctgcgcccctcgctcgacgccgcctacctctcctccgacgacgaccaagatcttgacgagttcgacccgctgaacgagcagagcaccccgctcgacacccacaaagctcgccgccgcctccgctccgaatcccaagtcggcgccggcgccgacgcctacacccacgatcgatggcgcaaccagcaccgccggccatgggcgcgcctcgcctccaccttcatgcccgcccgcaaacgcctgtggtgctggctgcccctcctcttcatcctcgccctcctcctgctcctcggtgccggcgggctgtgggcctggcgatccagcccgctcgacggccagagcccgccgtggtacccgtcgccgcgcggtggtgcggaccccaaatgggcggaggcatacagccgggcggcggcgctggtcggcaacatgacgctggtggagaaggtcaacgtcacgactggcgtgggctggtcgatggggctctgcgtgggcaacaccgggccggtcccgcgcctgggctttccgagtctttgcctgcaggatgggccgctgggcttgcgcttcgctgaccacgcgaccgcgtggcccgccggcctcaccgtcggcgccacctggagcaaggagctgatgtacctgcgcggtcaggcgcacgcgcgcgaggccaagggcaaaggcgtcaacgtcctgctcggtcccgcaatgggcccgctgggcaggctgcccgcaggcggtcgcaattgggaaggcttcggcgcggacccggtgctgcagggcctcgcggccgcgtggacgatcaaggggattcaagacgagggcgttatggcgacggcgaagcactacgtcggcaacgagcaggagcatttccgccaggcttgggaatggggcgcccccaacgccatctcctcgaacatcgatgaccgtacgctgcacgagatctacgcatggccattcgcggacagcgtgcgcatcggcgttgcgagcatcatgtgctcttacaaccaggtcaacaactcttatgcctgccagaacagcaagctgctcaatggcgtgctgaaggacgagctcggcttccagggattcgtgcagtcggactggctggcgcagcgcagcggcgttgcgagcgcgctagccgggctggacatgagtatgcccggggatggcctccggtggcaggacggcaagtcgttgtggggtccggagctgaccagggccgctttgaacacctcggtgcccatggaacgcctgaatgatatggccacgcggatcgtggccgcctggtaccagcttggccaggacgatccggagaagtggccggaaaatgggcctaacttttcctcctggacgggcgagaagatcggcttgttgcaccctggcagtgacgaccggactacgggcgaggtcaacaagtttgtcgacgtgcagggcaatggcacgcatggaaagcttgctcgcaggatcgccgctgagggaatcgtgctggtcaaaaatgtgaacgatacgctgcctatttcgcgtcaaggccacagcattgtgagcggcttcatctctaacaaggatgactttaaaatgcacgtcggtgtgtatggcgaggatgcgcgcggaaatccggagggccctaatgcctgtgtcgaccgcgggtgcaatgaaggcactctggcttctgggtgggggagtggcgccgtcgagttcccctatctcatcactcctcaggaagctcttaggcgtgagttcgacagcgatatggtgctgctgcacgagtatcctgcgaatgagatcccggagacgaaacagcgtgcgcttgaagagcaggatctctgccttgtgttcgtcaacagcgatgctggtgaaggcttcattgcttgggaaggtgtcaagggtgacaggaatgatctctacacgcagaaaggcggtgataagctagttgagactgtcgcaaaacgatgcggtggcggtgagagcccagtcattgtcgttgtacatgcagttggccccgttattctcgagaactggattgatatcccgaatgtcaagtctgttctgctcgcacacttgcccggtcaggagagcggaaatgcggttgcagacgttatctttggagacacaaatcccagtggccgactcccgtacacagttgcgaaacatgcggacgactatggcccggatagccatgtcatgtactatcccaatggtgtcgttccgcagcagaacttcactgaaggcctgtatatcgactaccgctacttcgataagaacggaatcacccctcggtacgagtttggctacggcctctcttacagcaagttcgagctctcacaactcgagataacggttgatcccaccaagaagactctcctcccagctccgcgccctgactccaagactctccctgctcctcccgatttcgacaacactgttcctccagctaaggaagcactcttccccgatggtttccgtcgtctgaagaagtacatctatccgtacctcaccagcctctccggaaccgacccagcgccctacaaagcgtatccggaagcttacaccaacaaaaaaaagcatgagaagccctcggaagccggcggcgggcccggtggtaacccggacttgtatacgtatgtcgctaacgtgtcgttcaccgttaaaaacctaagtcccgtccgtggccaggcggtgccgcagctgtatatctcgtacccagaaagctggacggacccggatttcccgctcgtatggggtcagggctacacgaaagaaggctcttcgactgactccgacaaggacaatgacaaattgaagcagcactccgaaggcatcatctccgacaacggcactattgcctcgcctttcttgactatcaacaccagcaaccctcatgctaatgagacggagcacgtccgtccggattggttcgacccccagatggtcgggcagctcagcgtcatcgatttccccgtccgcgtcctgagaggctgggagaaggtcgacctcgcgccggcgggcgagccgggcgattttgtgagagtgagtatcgcgattacgaggaaggatctgagctattgggatgttcggcggcagaattgggtcatgcccacggtcgggggtggcacgagggagtttggggtttggattgggtggagctcgagggacttggttttgagtgggatgatttga

SEQ ID NO: 72 - protein, 1082 aa, M. phaseolina
MPDDYELRGKYSAVDSQPHRRNASSNSNLRPSLDAAYLSSDDDQDLDEFDPLNEQSTPLDTHKARRRLRSESQVGAGADAYTHDRWRNQHRRPWARLASTFMPARKRLWCWLPLLFILALLLLLGAGGLWAWRSSPLDGQSPPWYPSPRGGADPKWAEAYSRAAALVGNMTLVEKVNVTTGVGWSMGLCVGNTGPVPRLGFPSLCLQDGPLGLRFADHATAWPAGLTVGATWSKELMYLRGQAHAREAKGKGVNVLLGPAMGPLGRLPAGGRNWEGFGADPVLQGLAAAWTIKGIQDEGVMATAKHYVGNEQEHFRQAWEWGAPNAISSNIDDRTLHEIYAWPFADSVRIGVASIMCSYNQVNNSYACQNSKLLNGVLKDELGFQGFVQSDWLAQRSGVASALAGLDMSMPGDGLRWQDGKSLWGPELTRAALNTSVPMERLNDMATRIVAAWYQLGQDDPEKWPENGPNFSSWTGEKIGLLHPGSDDRTTGEVNKFVDVQGNGTHGKLARRIAAEGIVLVKNVNDTLPISRQGHSIVSGFISNKDDFKMHVGVYGEDARGNPEGPNACVDRGCNEGTLASGWGSGAVEFPYLITPQEALRREFDSDMVLLHEYPANEIPETKQRALEEQDLCLVFVNSDAGEGFIAWEGVKGDRNDLYTQKGGDKLVETVAKRCGGGESPVIVVVHAVGPVILENWIDIPNVKSVLLAHLPGQESGNAVADVIFGDTNPSGRLPYTVAKHADDYGPDSHVMYYPNGVVPQQNFTEGLYIDYRYFDKNGITPRYEFGYGLSYSKFELSQLEITVDPTKKTLLPAPRPDSKTLPAPPDFDNTVPPAKEALFPDGFRRLKKYIYPYLTSLSGTDPAPYKAYPEAYTNKKKHEKPSEAGGGPGGNPDLYTYVANVSFTVKNLSPVRGQAVPQLYISYPESWTDPDFPLVWGQGYTKEGSSTDSDKDNDKLKQHSEGIISDNGTIASPFLTINTSNPHANETEHVRPDWFDPQMVGQLSVIDFPVRVLRGWEKVDLAPAGEPGDFVRVSIAITRKDLSYWDVRRQNWVMPTVGGGTREFGVWIGWSSRDLVLSGMI

SEQ ID NO: 73 - DNA, 3411 bp, M. phaseolina
tgcctgcatggattccccgctggccgcagagctaccctggccgctgctgaagtcattgacttgcctggcaatccttataaatatttccctgctccgccgccctcccagtttccccagccaggagccgcttctctcgtcgttgccgtcaacatgcgcttcaccacggccactgctgctcttgccgccgcgccacttgtggcttcccaggtacgcgttcctgctgtttgctcccgtccgcaccgaccaccgcacccacgacaccacgctctctctcccccgtccaactccactctccctttccaaccatgcaccaccatgtccctccaatcccgtggggccattcgaccgcgtcgaagctcctccgccctccaaacgctcgcgtcctcctgcaatcgtgcattgtgacggaagctttccgccctgtctttccgagcgctccacgcagtcaaagacgccactacgactcgtctgccggcgccggcgcttcgttcccgtcacgtcccttgcaattgtttctgcaaagttcccccgcaagcacctgctcgcgctcgagccagcgccttgcccacactggccatcgctaaactgtccataggccctcaacgactccagccccgacgacgctctctggggtgccacctccccgccatactacccttcgccatgggccgagggcactggcgagtgggcccatgcccacgccaaggctcaggaattcgtcaagcagatgaccctgcttgagaaggtcaacctgaccacgggtgttgggtatgcaactacctccttgcccccatttctgcgagctctgctgatccattgacagttgggagggcggcccatgtgttggcaatgttggttccgtgccgcgccttggcctgcactcgctgtgcatgcaggactcgcccactggtatccgcttcggtatgccagcccctccccggtaacatctatcagcttcctaaccatgcaacagccgactacaactccgccttcacctcgggcggaaccgtcgccgcatcttttgaccgccgtctctggtaccagcgcggccacgacatgggctccgaatttgccggcaagggcattgacgtgctccttgggcccgtcgttggtcccctggggcgcactcccacaggcggccgcaactgggagggtttcagccccgacccggccctctctggtatcgctgttgccgagaccatcaagggtatccaggacgccggtgttattgcctgcaccaagcactacatcgtcaacgagcaggagcacttccgccaggcgccggaggccaaggggtttggagtcaacatcaccgagtctctgagttccaacgtcgacgacgtcaccctgcacgagctttacctctggcccttcgccgacgcggtcaaggccggaactggcgccatcatgtgctcttacaaccagatcaacaacagctacggctgccagaactcccacctgctcaactacatcctcaagggtgagctcggcttccagggtttcgtcatgagcgattggcaggctcagcactctggtgttggctccgctttggctggtatggacatggccatgcctggtgacaccgtcttcagcaccggcgacgccttctggggcgccaacctgacgcttgctgtcatcaacggcaccgttcccgagtggcgcattgacgatgccgccacccgtatcctgtctgcctacttcttcgccaaccgcgacaagaactaccgcccgaccaacttcaactcctggaccctggacacctatggctatgctaacgccggcggtgaggccaactatggccttgtcaaccagcacgtcaacgtccgtgccaaccacgctaagaacatccgcgatgctgctgccaagtccaccgtcctcctcaagaacgtcgacggcactctccctcttaccggcaaggagaagttcattggtgtcttcggcagtgatgctggcgactccctgtctggccccaacggctgcgatgaccgcggatgcaccaacggtaccctcgctatgggttgggggtccggaactgccaacttcccttacctcgtctcgccgcttactgccatctctaacgaggttattgagaacaacggcgtcattgactgggtcaccgatgactggaactacgacaggatcttcgctcttgctgcgcaggtcagccacgccatcgtctttgtcaactccgacagcggcgagggttacatcaacttcgacggcaacattggtgaccgcaacaacctcaccctctggcacgacggtgaggccctgatccgcaatgttacctctgtcaacaacaacaccatcgtcgtcatccacagcgtcggccccgtcgagcttggtgccttcaacgacaaccccaacgtgactgccctgatctgggccggtctccctggcgagcagtctggtaatgctcttgccgacatcctttacggccgcgtcaaccctggtgccaagcttcccttcacgttcggcgccaagcgtgaggactatggcaccgagctcctgtacgagcccaacaatggggagaacgctccccaggacaacttcaaggagggtgtcttcatcgactaccgtggcttcgacaagcgcaacgtgacccccatctacgagttcggtttcggtctgtcctacactaccttctcctactcggacatcaaggtcgtcaagcacaccgtcgccgactacacgcccaacaccggcaacacttccgccgcacccatcctgggcaacttcagcaccgacctcgccgactaccagttcccgcccgagatcactcccgtctccggctacatctacccctatctcaactcgaccgatgccgccgaggccaacaacgactctgaggtcgagtacggcctccccaacgactcctacatccccgagggcgccctcgacggctccccgcagcccaagatcgctgctggtggtgcgcccggcggtaaccccgctctttacgacgtcctcttcaccgtcaccgccaccgtcaccaacacgggcgacgttgagggtgacgaggtgccccagctgtacgtctcgctcggcggccccaatgaccccgtcgtccagctccgcggcttcgagcgctacaccatcgctccgggcgccaccgccacctttggcgtcgatgtcaccaggagggacctgagcaactgggacaccgtcagccagaactgggtcattactgaataccccaagacggtgtatgtgggtagctcgtcgaggaacttgcctctgtcagcggaattggatatctgaaggacttcaatggacggggaagaagtagttaatcgcttgattctacataatgacgtattggggatgtaatgaaataatgattttggacgctacactgttctccctgcatgtgtgaatgcttcggatgaaactcctgtgaaactatgtcat

SEQ ID NO: 74 - DNA, 2616 bp, M. phaseolina
atgcgcttcaccacggccactgctgctcttgccgccgcgccacttgtggcttcccaggccctcaacgactccagccccgacgacgctctctggggtgccacctccccgccatactacccttcgccatgggccgagggcactggcgagtgggcccatgcccacgccaaggctcaggaattcgtcaagcagatgaccctgcttgagaaggtcaacctgaccacgggtgttggttgggagggcggcccatgtgttggcaatgttggttccgtgccgcgccttggcctgcactcgctgtgcatgcaggactcgcccactggtatccgcttcgccgactacaactccgccttcacctcgggcggaaccgtcgccgcatcttttgaccgccgtctctggtaccagcgcggccacgacatgggctccgaatttgccggcaagggcattgacgtgctccttgggcccgtcgttggtcccctggggcgcactcccacaggcggccgcaactgggagggtttcagccccgacccggccctctctggtatcgctgttgccgagaccatcaagggtatccaggacgccggtgttattgcctgcaccaagcactacatcgtcaacgagcaggagcacttccgccaggcgccggaggccaaggggtttggagtcaacatcaccgagtctctgagttccaacgtcgacgacgtcaccctgcacgagctttacctctggcccttcgccgacgcggtcaaggccggaactggcgccatcatgtgctcttacaaccagatcaacaacagctacggctgccagaactcccacctgctcaactacatcctcaagggtgagctcggcttccagggtttcgtcatgagcgattggcaggctcagcactctggtgttggctccgctttggctggtatggacatggccatgcctggtgacaccgtcttcagcaccggcgacgccttctggggcgccaacctgacgcttgctgtcatcaacggcaccgttcccgagtggcgcattgacgatgccgccacccgtatcctgtctgcctacttcttcgccaaccgcgacaagaactaccgcccgaccaacttcaactcctggaccctggacacctatggctatgctaacgccggcggtgaggccaactatggccttgtcaaccagcacgtcaacgtccgtgccaaccacgctaagaacatccgcgatgctgctgccaagtccaccgtcctcctcaagaacgtcgacggcactctccctcttaccggcaaggagaagttcattggtgtcttcggcagtgatgctggcgactccctgtctggccccaacggctgcgatgaccgcggatgcaccaacggtaccctcgctatgggttgggggtccggaactgccaacttcccttacctcgtctcgccgcttactgccatctctaacgaggttattgagaacaacggcgtcattgactgggtcaccgatgactggaactacgacaggatcttcgctcttgctgcgcaggtcagccacgccatcgtctttgtcaactccgacagcggcgagggttacatcaacttcgacggcaacattggtgaccgcaacaacctcaccctctggcacgacggtgaggccctgatccgcaatgttacctctgtcaacaacaacaccatcgtcgtcatccacagcgtcggccccgtcgagcttggtgccttcaacgacaaccccaacgtgactgccctgatctgggccggtctccctggcgagcagtctggtaatgctcttgccgacatcctttacggccgcgtcaaccctggtgccaagcttcccttcacgttcggcgccaagcgtgaggactatggcaccgagctcctgtacgagcccaacaatggggagaacgctccccaggacaacttcaaggagggtgtcttcatcgactaccgtggcttcgacaagcgcaacgtgacccccatctacgagttcggtttcggtctgtcctacactaccttctcctactcggacatcaaggtcgtcaagcacaccgtcgccgactacacgcccaacaccggcaacacttccgccgcacccatcctgggcaacttcagcaccgacctcgccgactaccagttcccgcccgagatcactcccgtctccggctacatctacccctatctcaactcgaccgatgccgccgaggccaacaacgactctgaggtcgagtacggcctccccaacgactcctacatccccgagggcgccctcgacggctccccgcagcccaagatcgctgctggtggtgcgcccggcggtaaccccgctctttacgacgtcctcttcaccgtcaccgccaccgtcaccaacacgggcgacgttgagggtgacgaggtgccccagctgtacgtctcgctcggcggccccaatgaccccgtcgtccagctccgcggcttcgagcgctacaccatcgctccgggcgccaccgccacctttggcgtcgatgtcaccaggagggacctgagcaactgggacaccgtcagccagaactgggtcattactgaataccccaagacggtgtatgtgggtagctcgtcgaggaacttgcctctgtcagcggaattggatatctga

SEQ ID NO: 75 - protein, 871 aa, M. phaseolina
MRFTTATAALAAAPLVASQALNDSSPDDALWGATSPPYYPSPWAEGTGEWAHAHAKAQEFVKQMTLLEKVNLTTGVGWEGGPCVGNVGSVPRLGLHSLCMQDSPTGIRFADYNSAFTSGGTVAASFDRRLWYQRGHDMGSEFAGKGIDVLLGPVVGPLGRTPTGGRNWEGFSPDPALSGIAVAETIKGIQDAGVIACTKHYIVNEQEHFRQAPEAKGFGVNITESLSSNVDDVTLHELYLWPFADAVKAGTGAIMCSYNQINNSYGCQNSHLLNYILKGELGFQGFVMSDWQAQHSGVGSALAGMDMAMPGDTVFSTGDAFWGANLTLAVINGTVPEWRIDDAATRILSAYFFANRDKNYRPTNFNSWTLDTYGYANAGGEANYGLVNQHVNVRANHAKNIRDAAAKSTVLLKNVDGTLPLTGKEKFIGVFGSDAGDSLSGPNGCDDRGCTNGTLAMGWGSGTANFPYLVSPLTAISNEVIENNGVIDWVTDDWNYDRIFALAAQVSHAIVFVNSDSGEGYINFDGNIGDRNNLTLWHDGEALIRNVTSVNNNTIVVIHSVGPVELGAFNDNPNVTALIWAGLPGEQSGNALADILYGRVNPGAKLPFTFGAKREDYGTELLYEPNNGENAPQDNFKEGVFIDYRGFDKRNVTPIYEFGFGLSYTTFSYSDIKVVKHTVADYTPNTGNTSAAPILGNFSTDLADYQFPPEITPVSGYIYPYLNSTDAAEANNDSEVEYGLPNDSYIPEGALDGSPQPKIAAGGAPGGNPALYDVLFTVTATVTNTGDVEGDEVPQLYVSLGGPNDPVVQLRGFERYTIAPGATATFGVDVTRRDLSNWDTVSQNWVITEYPKTVYVGSSSRNLPLSAELDI

SEQ ID NO: 76 - DNA, 2818 bp, M. phaseolina
gccgccgcgtcgctctggttagccaccatgttggatcatcgtatgaatagcgagctcttctcccgtacatagcctgatcttccactcctcagtctgtctcgcttattcgacagccattctttacttcgtgaccgcgtttcttttccgaacatgagagctttcaccgctttcggtgttgcttcaacgctcgtttcgagcagctacgccgcttccaattcgtccgcttccgcctccatcctgtcttccggtaaaggcaagttttgttccatgaatgctccagctattttgttcagcaccctcatacctactgcgcacagtgcagcttggcaacttcgaagcggcatacgagaaagccaaagccctggttgccggtctgagcaacaccgaaaaaatttccatcatcaccggcggcgatgctactggcaccaacgttacctggaccgcccttgagaacaaggatggcgccagcggcatcaactaccagtactatgtctccggattcagcatggacaacgccctggccatgacctgggatagggactacttcgagcagcagaacaaggccctcggccgcgagttctatctgaccggctacaatctcatcaacggccccgaatgtggtccccttggccgaacgccttggggtggtcgccaggctgaggcctacagccctgaccgtgagtgcctccgaggaaagtaaaccgacaaccgcgggctaacatggctcccagcctacctctccggtgccgtcatgtccaaggctatcgctgcaatgaacgccgcgggtgtcgtcgccggcggcaggcatttcctcctgaacgaacaggagacgaaccgttcctccagcatctcggccaccacgaccagcgtctatacgtccaatgccgatgataagacgatccacgagctctacctctggcccttccaggagggtgtcaaggctggcatggccgctgtcatgtgcgccatgactcgtgttaacggtaccctctcctgcgagaacagtgacttggtgtccggccttctcaagtccgagctcggcttccccggcatggtcttcccagatgtcaactcgcaggcgacatcgtacgggtcggcgaacgccggcctcgactacggctcaagctcttactggacttcagacatcctcgaagcgggtattgccaacggctctttcactcaggcccgcctggatgatatggctgtccgcaacctgatcggctatttctatgtcgggctggacgatggcaagcagcccgaggtggccagcacgaccgagtaccgcgacgtgcgtgccaaccactcggccctgatccgcgagattggcgccgcctcgctcgtcctactcaagaacaacaacaccgtcgccggccagggtctacccctgaaccgccctcgcaccatcagcgtcttcggcgcccacgctggtcccgccctggctggacccaaccaggctttctctgtccagggtaccgacggcccgacgtacgacggtcacctcgcgtccgggagtggcagtggtgccctatccttctcctacctcatcactcccttccagagtcttagcacccgcgccgctgccgacggcagcatgatccgctggatcctcaacgatacctattcctcctcgagcagcggcggcatgggcggcggtatgggcggtagtcacggcggttttccgaccatgagcggcaactcgagctctagcggcaacggcaccgacggcggcatgggtggcggcgctgcggcaggcggtgctggcggcggcatcagcatcagcggccagggcaccgccgtcaccccgagtatcgaggcctacgccgaggacagcgaggtatgcctcgtcttcctcaactctttctcgggcgagggcggcgaccgcgaggagctctacaacgccgaccaggacacgctcgtctccacggtcgcctccagctgcaacaacaccatcgtcgtcatcaataccgtcggcccgcgcctggtcgacgcgtggatcgagaacgagaatgtcacctcggtcctctacggcggcctgctcggccaggagtccggcaacgccatcgccgacgtgctgtacggcgacgtcaacccgtcgggcaaactgatcaacacgatcgccaagaacgagaccgactaccccgtctccatctgctacaccgaggtctgcgacttctccgagggcatctacatcgattaccgccacttcgacaagttcaacgtgaccccgcgctaccccttcggccacggcctgtcctacacaaccttcgcattcggcgccgtcgccgcgcagaagaccgacgaatccgcgctcgcctcggcgtacccgaccggcccgctcgccgtcggcggcaagacggatctcttcgacgaggtcatcgccgtcaccacgtccgtcaccaacactggtgacgtcgacggcgcagaggtcgcccagctgtacgtcgcctacccggccgccgccgaccagcccgtgcgccagctgcgcggcttcgagaaggtcaagctggccaagggcgagaagaaggaggtcactttcagcgtccgcaggaaggacgtctcctactgggacaccgccgcccaggagtgggccatcgcccccggcacgtacaccttctccgtcggcgccagctcgcgcgacctaaagggcgaggccaccgtcacaatctgagtggagctgtaaatgagcggtatagaactcccggggttggtggcgcgacgtctgtagatacacggtttaaggtggcatttttatgtgtgtatttttgtagtcttctccatgtgaatgtatatattcagtcgtatatttgcggtaaagatt

SEQ ID NO: 77 - DNA, 2418 bp, M. phaseolina
atgagagctttcaccgctttcggtgttgcttcaacgctcgtttcgagcagctacgccgcttccaattcgtccgcttccgcctccatcctgtcttccgcaccctcatacctactgcgcacagtgcagcttggcaacttcgaagcggcatacgagaaagccaaagccctggttgccggtctgagcaacaccgaaaaaatttccatcatcaccggcggcgatgctactggcaccaacgttacctggaccgcccttgagaacaaggatggcgccagcggcatcaactaccagtactatgtctccggattcagcatggacaacgccctggccatgacctgggatagggactacttcgagcagcagaacaaggccctcggccgcgagttctatctgaccggctacaatctcatcaacggccccgaatgtggtccccttggccgaacgccttggggtggtcgccaggctgaggcctacagccctgacccctacctctccggtgccgtcatgtccaaggctatcgctgcaatgaacgccgcgggtgtcgtcgccggcggcaggcatttcctcctgaacgaacaggagacgaaccgttcctccagcatctcggccaccacgaccagcgtctatacgtccaatgccgatgataagacgatccacgagctctacctctggcccttccaggagggtgtcaaggctggcatggccgctgtcatgtgcgccatgactcgtgttaacggtaccctctcctgcgagaacagtgacttggtgtccggccttctcaagtccgagctcggcttccccggcatggtcttcccagatgtcaactcgcaggcgacatcgtacgggtcggcgaacgccggcctcgactacggctcaagctcttactggacttcagacatcctcgaagcgggtattgccaacggctctttcactcaggcccgcctggatgatatggctgtccgcaacctgatcggctatttctatgtcgggctggacgatggcaagcagcccgaggtggccagcacgaccgagtaccgcgacgtgcgtgccaaccactcggccctgatccgcgagattggcgccgcctcgctcgtcctactcaagaacaacaacaccgtcgccggccagggtctacccctgaaccgccctcgcaccatcagcgtcttcggcgcccacgctggtcccgccctggctggacccaaccaggctttctctgtccagggtaccgacggcccgacgtacgacggtcacctcgcgtccgggagtggcagtggtgccctatccttctcctacctcatcactcccttccagagtcttagcacccgcgccgctgccgacggcagcatgatccgctggatcctcaacgatacctattcctcctcgagcagcggcggcatgggcggcggtatgggcggtagtcacggcggttttccgaccatgagcggcaactcgagctctagcggcaacggcaccgacggcggcatgggtggcggcgctgcggcaggcggtgctggcggcggcatcagcatcagcggccagggcaccgccgtcaccccgagtatcgaggcctacgccgaggacagcgaggtatgcctcgtcttcctcaactctttctcgggcgagggcggcgaccgcgaggagctctacaacgccgaccaggacacgctcgtctccacggtcgcctccagctgcaacaacaccatcgtcgtcatcaataccgtcggcccgcgcctggtcgacgcgtggatcgagaacgagaatgtcacctcggtcctctacggcggcctgctcggccaggagtccggcaacgccatcgccgacgtgctgtacggcgacgtcaacccgtcgggcaaactgatcaacacgatcgccaagaacgagaccgactaccccgtctccatctgctacaccgaggtctgcgacttctccgagggcatctacatcgattaccgccacttcgacaagttcaacgtgaccccgcgctaccccttcggccacggcctgtcctacacaaccttcgcattcggcgccgtcgccgcgcagaagaccgacgaatccgcgctcgcctcggcgtacccgaccggcccgctcgccgtcggcggcaagacggatctcttcgacgaggtcatcgccgtcaccacgtccgtcaccaacactggtgacgtcgacggcgcagaggtcgcccagctgtacgtcgcctacccggccgccgccgaccagcccgtgcgccagctgcgcggcttcgagaaggtcaagctggccaagggcgagaagaaggaggtcactttcagcgtccgcaggaaggacgtctcctactgggacaccgccgcccaggagtgggccatcgcccccggcacgtacaccttctccgtcggcgccagctcgcgcgacctaaagggcgaggccaccgtcacaatctga

SEQ ID NO: 78 - protein, 805 aa, M. phaseolina
MRAFTAFGVASTLVSSSYAASNSSASASILSSAPSYLLRTVQLGNFEAAYEKAKALVAGLSNTEKISIITGGDATGTNVTWTALENKDGASGINYQYYVSGFSMDNALAMTWDRDYFEQQNKALGREFYLTGYNLINGPECGPLGRTPWGGRQAEAYSPDPYLSGAVMSKAIAAMNAAGVVAGGRHFLLNEQETNRSSSISATTTSVYTSNADDKTIHELYLWPFQEGVKAGMAAVMCAMTRVNGTLSCENSDLVSGLLKSELGFPGMVFPDVNSQATSYGSANAGLDYGSSSYWTSDILEAGIANGSFTQARLDDMAVRNLIGYFYVGLDDGKQPEVASTTEYRDVRANHSALIREIGAASLVLLKNNNTVAGQGLPLNRPRTISVFGAHAGPALAGPNQAFSVQGTDGPTYDGHLASGSGSGALSFSYLITPFQSLSTRAAADGSMIRWILNDTYSSSSSGGMGGGMGGSHGGFPTMSGNSSSSGNGTDGGMGGGAAAGGAGGGISISGQGTAVTPSIEAYAEDSEVCLVFLNSFSGEGGDREELYNADQDTLVSTVASSCNNTIVVINTVGPRLVDAWIENENVTSVLYGGLLGQESGNAIADVLYGDVNPSGKLINTIAKNETDYPVSICYTEVCDFSEGIYIDYRHFDKFNVTPRYPFGHGLSYTTFAFGAVAAQKTDESALASAYPTGPLAVGGKTDLFDEVIAVTTSVTNTGDVDGAEVAQLYVAYPAAADQPVRQLRGFEKVKLAKGEKKEVTFSVRRKDVSYWDTAAQEWAIAPGTYTFSVGASSRDLKGEATVTI

SEQ ID NO: 79 - DNA, 2990 bp, M. phaseolina
ggacgtcattcatttaaagagggaccgggagacacatttccttaaattcgcgttctgtcgtgtcttgagacaagaacccgcagttcttcccctttttcttcattctcgaaagagacgtcgatttttcttgctatcgacgttgccagaacaatggtctcgagctcggcgagtgcttatttgacggccgtcgccgttgtggctgccgccgctggcgtcgccaatggccaggccgtcaccaacggcaccgcgccactgtacaagaacccgtccgctccggtcgaggaccgtgtccaggatctgctctcgcgcatgaccctccaggaaaaggtggcgcagctgattcagggcgacatcaccaatttcattaatcagactactggcgagttcaatgccagcggtctggcgtggaatatggagtggagggctggccagatctggactggctatcccattcctcaggtcagcttccgtcgtgaaaacagatgtcttttgtgtgtgtctctgattttggagtagcgttggatcgcggacgcgggtaagactgcgcaggactacctgctgcacaacaccactcttggcatcccggcgttggtaagatcatgcccgaagcttgagctgagccacgtggctaatgaaaacgcaacagctgcaaaatgagggtattcacggaggtgaggtctatcactacatcgaaacgcccacaaagctcacagcttcccagtggcttacttcaacgcgaccatcttcaacagccccatcgcccacgcctgctcgttcaatccggacctcatcggcgagatgggcgccgtcatcgcgcaggaggctctcgccctcggcatcaaccagatcttcgctcccgtcgtcgacctcgcgcgcgagttgcgcttcggcagagttgaggaaacttacggcgaggacccgtacctggctggcgaaatgggttacgcatacgttcgcgctctggagagccagaatgtcagcgccatggtcaagcactttgctgggttcagcaaccccgagcagggcctcaacactgggcctgtgcatggcggagagcgtgagttgaggacgacttggctgccacctttccaccgtgctatcattgatggcggtgctacgtcgataatgtcggcttaccactcttgggatggtgtgccggcagttgctgactatcacaccctcactgaggtaagctattcgggagtttcagggtggacacggttttcctggccgtgcccccgaggagtcttcccaaattgccctggaaatgcgtgagtgaggccaaaaagctgacgaccatcaatagattctccgtgaagaatggggatacgaatactacgttagctccgatgctggcggaacagatcgcctttgcaacgctttcaagatgtgccgctccaacccaattgacaaggaagctgtcacaatgtacgccctgcccgccggaaacgatgttgagatgggaggaggctcctacaacttcgagaccatcatcgaccttatcggctccggtaagctggacatcgacatcgtggacactgccgttgccagaactctccggaccaagttcttcctcggcctgttcgaggacccctaccgtgccgtccccgccaacgagaccgccctccacattcacactgccaagtctgtcgaccttgcacgtaagctggacgccgagtccattgtcctgctcgagaaccatgacaacgtcctgccgctcgacaagtctgccaacatcgccgtcatcggccccatggcagacttcatgaacgtgagctagcaacccaaccaaaaaaaaaaaaaaatcccatattctcactaacagcacctctccagtacggcgactatgtcgtccaagactcgcaataccgcggcgtcacgccctacgctggcatcgccgccgcgtcgaccggcaccgtgacctacaccctcggcacagagcgctggtcgaccgacacgtcgggcttcccagccgctatcgccgccgcgcaagccgcggacgtcgccgtcgtcgtcgtcggcacgtggtcgcgcgaccagacgcagctgtggcagggtctcaacgcgacgacgggcgagcacgtggacgtgcatgacctggcgctcgtcggcgcgcaggcggcgctggtcaaggccatcatcgcgactggcaagcccaccgtcgtcgtcttccagtcgggcaagcccgtcaccgagccatggatctcgcgcaacgcctccgccctcgtccagcagttctacccgggcgagcaaggcggcaacgccctcgccgacgtgctgttcggcgaccacaatcccagcggcaagctggccgtcggcttcccgtacgacgtcggcacgacgcccgtcttctacgactacctcaactccggccgcaccgtcgacgccgggcaggtgttcgacaatgggaccctgctgttcgggcaccagtacgtcctctcctcgccgctgccgctgtacgagttcgggtacggcaagagctacgccgagtttgcgtactcgaacgtgacgctgtccaaggctaccgccagtgcgacggatgttgtcacggccacggtgagcgtgacgaacaactcgacgagggatggccaggaggtcgtgcagctgtacgtcagcgacttgattgccagcgtggctgtgccgaacaaggagttgaaggggtttaagaaggtttttatcccggcaggcgagacggtcgatgtcgcgattgatattgatgtgagtaaattgggcgtgtgggatatcaggatgaagtatgtggtcgagccgggcgagttcgcgatttgggtcggtagctcgagtgcggatttgagggggaatgcgacgctgacggtagagtaaaggggaggggggaggaaacgaatggatcggtgggagtggtgggttgcggattcgattctgttgtatatatttgtaaatactgtttgaggatgttcacatggtgggcagctggttgcaatcctgcaaataagattcggcttatgtagttg

SEQ ID NO: 80 - DNA, 2346 bp, M. phaseolina
atggtctcgagctcggcgagtgcttatttgacggccgtcgccgttgtggctgccgccgctggcgtcgccaatggccaggccgtcaccaacggcaccgcgccactgtacaagaacccgtccgctccggtcgaggaccgtgtccaggatctgctctcgcgcatgaccctccaggaaaaggtggcgcagctgattcagggcgacatcaccaatttcattaatcagactactggcgagttcaatgccagcggtctggcgtggaatatggagtggagggctggccagatctggactggctatcccattcctcagcgttggatcgcggacgcgggtaagactgcgcaggactacctgctgcacaacaccactcttggcatcccggcgttgctgcaaaatgagggtattcacggagtggcttacttcaacgcgaccatcttcaacagccccatcgcccacgcctgctcgttcaatccggacctcatcggcgagatgggcgccgtcatcgcgcaggaggctctcgccctcggcatcaaccagatcttcgctcccgtcgtcgacctcgcgcgcgagttgcgcttcggcagagttgaggaaacttacggcgaggacccgtacctggctggcgaaatgggttacgcatacgttcgcgctctggagagccagaatgtcagcgccatggtcaagcactttgctgggttcagcaaccccgagcagggcctcaacactgggcctgtgcatggcggagagcgtgagttgaggacgacttggctgccacctttccaccgtgctatcattgatggcggtgctacgtcgataatgtcggcttaccactcttgggatggtgtgccggcagttgctgactatcacaccctcactgagattctccgtgaagaatggggatacgaatactacgttagctccgatgctggcggaacagatcgcctttgcaacgctttcaagatgtgccgctccaacccaattgacaaggaagctgtcacaatgtacgccctgcccgccggaaacgatgttgagatgggaggaggctcctacaacttcgagaccatcatcgaccttatcggctccggtaagctggacatcgacatcgtggacactgccgttgccagaactctccggaccaagttcttcctcggcctgttcgaggacccctaccgtgccgtccccgccaacgagaccgccctccacattcacactgccaagtctgtcgaccttgcacgtaagctggacgccgagtccattgtcctgctcgagaaccatgacaacgtcctgccgctcgacaagtctgccaacatcgccgtcatcggccccatggcagacttcatgaactacggcgactatgtcgtccaagactcgcaataccgcggcgtcacgccctacgctggcatcgccgccgcgtcgaccggcaccgtgacctacaccctcggcacagagcgctggtcgaccgacacgtcgggcttcccagccgctatcgccgccgcgcaagccgcggacgtcgccgtcgtcgtcgtcggcacgtggtcgcgcgaccagacgcagctgtggcagggtctcaacgcgacgacgggcgagcacgtggacgtgcatgacctggcgctcgtcggcgcgcaggcggcgctggtcaaggccatcatcgcgactggcaagcccaccgtcgtcgtcttccagtcgggcaagcccgtcaccgagccatggatctcgcgcaacgcctccgccctcgtccagcagttctacccgggcgagcaaggcggcaacgccctcgccgacgtgctgttcggcgaccacaatcccagcggcaagctggccgtcggcttcccgtacgacgtcggcacgacgcccgtcttctacgactacctcaactccggccgcaccgtcgacgccgggcaggtgttcgacaatgggaccctgctgttcgggcaccagtacgtcctctcctcgccgctgccgctgtacgagttcgggtacggcaagagctacgccgagtttgcgtactcgaacgtgacgctgtccaaggctaccgccagtgcgacggatgttgtcacggccacggtgagcgtgacgaacaactcgacgagggatggccaggaggtcgtgcagctgtacgtcagcgacttgattgccagcgtggctgtgccgaacaaggagttgaaggggtttaagaaggtttttatcccggcaggcgagacggtcgatgtcgcgattgatattgatgtgagtaaattgggcgtgtgggatatcaggatgaagtatgtggtcgagccgggcgagttcgcgatttgggtcggtagctcgagtgcggatttgagggggaatgcgacgctgacggtagagtaa

SEQ ID NO: 81 - protein, 781 aa, M. phaseolina
MVSSSASAYLTAVAVVAAAAGVANGQAVTNGTAPLYKNPSAPVEDRVQDLLSRMTLQEKVAQLIQGDITNFINQTTGEFNASGLAWNMEWRAGQIWTGYPIPQRWIADAGKTAQDYLLHNTTLGIPALLQNEGIHGVAYFNATIFNSPIAHACSFNPDLIGEMGAVIAQEALALGINQIFAPVVDLARELRFGRVEETYGEDPYLAGEMGYAYVRALESQNVSAMVKHFAGFSNPEQGLNTGPVHGGERELRTTWLPPFHRAIIDGGATSIMSAYHSWDGVPAVADYHTLTEILREEWGYEYYVSSDAGGTDRLCNAFKMCRSNPIDKEAVTMYALPAGNDVEMGGGSYNFETIIDLIGSGKLDIDIVDTAVARTLRTKFFLGLFEDPYRAVPANETALHIHTAKSVDLARKLDAESIVLLENHDNVLPLDKSANIAVIGPMADFMNYGDYVVQDSQYRGVTPYAGIAAASTGTVTYTLGTERWSTDTSGFPAAIAAAQAADVAVVVVGTWSRDQTQLWQGLNATTGEHVDVHDLALVGAQAALVKAIIATGKPTVVVFQSGKPVTEPWISRNASALVQQFYPGEQGGNALADVLFGDHNPSGKLAVGFPYDVGTTPVFYDYLNSGRTVDAGQVFDNGTLLFGHQYVLSSPLPLYEFGYGKSYAEFAYSNVTLSKATASATDVVTATVSVTNNSTRDGQEVVQLYVSDLIASVAVPNKELKGFKKVFIPAGETVDVAIDIDVSKLGVWDIRMKYVVEPGEFAIWVGSSSADLRGNATLTVE

SEQ ID NO: 82 - DNA, 2954 bp, M. phaseolina
ctggacggctctgcggaagtacaaagatgcagccttccgctctcccagccggagagtggcatcagccttctgctgccgttccacctcgtctgcccttttttccggctcgccgtgcggggtagggtttgtggtactccatcgtcttccgttatggcgcccatagatgtcgaagatgcgctttcgaagctggagctgaacgagaaagtcgagctgctctctggtaagggcccgcccgccaagtgagtatcctcgtcatttacagcggcgcaggcatcgatttctggcacaccaagcccatccctcgtcttggaatcccatccatacgcacatccgacggccccaatggcgttcgtggcacccgcttcttcaacggcgtccccgctgcctgctttccctgcggtaccggactggcagccacctgggatgtcgacctcatccgcgacggaggcaagctgatgggcaaggaggcaatcgcgaaaggcgcccatgtcattcttggcccgaccaccaacatgcagcgcggcccgcttggtagacgggggttcgaaagcttcagcgaagatccgttccttgctggtgcaatgagtgccgctactgtggacgggatccagtcaaccggcgttgcggctaccatcaagcacttcgtgtgcaacgaccaggagcacgagaggcaggcagtggattcaatcgtcagcgaaagggcaatccgcgaaatctacctcatgccgttccagatcgcgcaacgagatgcacagccaatggcctacatgactgcctacaaccgcgtcaacggtgtgcatatgagcgacaacaagaagatcctccaaggcattctccgtgatgagtggggttttgacggcttggtaatgagtgactggtatgattttctccttcacgtcctttgaatcagccgctcacggagaccaaaggttcggcacctacacgtcagcggattccgtcaatgccggattagacctcgaaatgcctggcccgccaagggtccgtggccagcagactctgatcgcccacagcgtccgtaaaatctccgatgacaccattgatgagcgtgtgcgaaaggtgctggagctggtcaacaaggttgacaaactcaacattcctgagaacgcgcccgagagatcgatcgactctcctgaaacgtcaaaggcgctgcgcaatgtcgcagcctctggactggtactcatgaagaatgagaagaacgtcctccccctcaagaaagagcagtcgcttgctgtcatcggtcctaacgctaagatcgcagcctacgctggtggcggatccgccaacctgaggccctactacgccgtcaccccgttggaggggatcagcgcgcagaagagtgacgttaagtactctctgggagccgtcggatacaggagcttgcctgttctcagctacctcacgaagacaaaagatggggacagaggcctgaccgcgagattcttcaaagagcctcctaccgacaagagccgcaaacacgtggatgaagttcacgtcgaagcatcagatattcttctctccgactacaagcaccccgagataacaagtgacacgttctacatggacctggaaggaatactgacaccggaggagtctggagagtacatcttcggcgtctctgtttgcggcacagcaaagctgttcattggggacaagctggtggtggacaacacggagaaccaacgccagggagacaccttcttcgggtctggcacagtcgaagagactggcaccatgcagctggaggctgggaagagctaccaagtttatctgcagtttggatcaagcaccacatcgaacatgaaaaccccaggagcaacagttatggcaggtggaggtgtgcgggttggcggtacgaagcagacggacccacaggtggagattgaaaaagctgtcgtgcttgccaaggaggtggatcaggtggtcgtcattgcgggcctcaatgtgagcaaccgtccggcaattgcaaagcaactttcgaagactgacatgagtagggtgattgggaatcagaaggctacgaccgcaggcacatggacctgcccggttacactgacgcgttgatctccgcggtagccgctgcgaaccccaacacagccgtcgtcatgcaatcgggcactcctgtctgcatgccctggatcgacgaggtgcctgccctcgtacacgcctggtatggaggcaacgaaaccggaaacgccattgcagacgtgatctttggtaccgtcaacccgtctggcaagctctcgctctcgtttcccgtccgcaacgaggacaaccctgccttcctcaacttccgctccgagcgcggccgcgctctttacggcgaggatgtctacattggataccgcttttacgagaaaacgaagagggacgtcctgtttcctttcggccacggtctctcatacacgtctttcgatatcagcaacctgcaggtcaccgacgacgatgcgggtgaaaagattacgatcaaggtcgatgtcaagaacacaggcgcgctcgagggcgctcaggttgtgcaggtttacgtcagccaacgccacccgtcgattaaccggcctccgaaggagctgaaggggtttgccaaggttttgctcaagcctggcgaggtgaggcaggccaccgttcatgtgtcaaagaaatatgcggcgagtttctgggatgagctgaaggacgcgtggattatggagaaagatgagtatgatgttttggtgggcgacagtagtgctagtacgccgctgcagggaagtttcaaggtgggcgaaacttcgtggtggaaggggctctagaggtgaccgggaaaagcaggatacggactcaggccgcttgcaacagaacgggccttttctcgtccatgaccgctcgctcatacttggtcggtttcgtgagcacgagacctttccacgttccggggcgagccatgcaattgttttgccaca

SEQ ID NO: 83 - DNA, 2499 bp, M. phaseolina
atggcgcccatagatgtcgaagatgcgctttcgaagctggagctgaacgagaaagtcgagctgctctctggcatcgatttctggcacaccaagcccatccctcgtcttggaatcccatccatacgcacatccgacggccccaatggcgttcgtggcacccgcttcttcaacggcgtccccgctgcctgctttccctgcggtaccggactggcagccacctgggatgtcgacctcatccgcgacggaggcaagctgatgggcaaggaggcaatcgcgaaaggcgcccatgtcattcttggcccgaccaccaacatgcagcgcggcccgcttggtagacgggggttcgaaagcttcagcgaagatccgttccttgctggtgcaatgagtgccgctactgtggacgggatccagtcaaccggcgttgcggctaccatcaagcacttcgtgtgcaacgaccaggagcacgagaggcaggcagtggattcaatcgtcagcgaaagggcaatccgcgaaatctacctcatgccgttccagatcgcgcaacgagatgcacagccaatggcctacatgactgcctacaaccgcgtcaacggtgtgcatatgagcgacaacaagaagatcctccaaggcattctccgtgatgagtggggttttgacggcttggtaatgagtgactggttcggcacctacacgtcagcggattccgtcaatgccggattagacctcgaaatgcctggcccgccaagggtccgtggccagcagactctgatcgcccacagcgtccgtaaaatctccgatgacaccattgatgagcgtgtgcgaaaggtgctggagctggtcaacaaggttgacaaactcaacattcctgagaacgcgcccgagagatcgatcgactctcctgaaacgtcaaaggcgctgcgcaatgtcgcagcctctggactggtactcatgaagaatgagaagaacgtcctccccctcaagaaagagcagtcgcttgctgtcatcggtcctaacgctaagatcgcagcctacgctggtggcggatccgccaacctgaggccctactacgccgtcaccccgttggaggggatcagcgcgcagaagagtgacgttaagtactctctgggagccgtcggatacaggagcttgcctgttctcagctacctcacgaagacaaaagatggggacagaggcctgaccgcgagattcttcaaagagcctcctaccgacaagagccgcaaacacgtggatgaagttcacgtcgaagcatcagatattcttctctccgactacaagcaccccgagataacaagtgacacgttctacatggacctggaaggaatactgacaccggaggagtctggagagtacatcttcggcgtctctgtttgcggcacagcaaagctgttcattggggacaagctggtggtggacaacacggagaaccaacgccagggagacaccttcttcgggtctggcacagtcgaagagactggcaccatgcagctggaggctgggaagagctaccaagtttatctgcagtttggatcaagcaccacatcgaacatgaaaaccccaggagcaacagttatggcaggtggaggtgtgcgggttggcggtacgaagcagacggacccacaggtggagattgaaaaagctgtcgtgcttgccaaggaggtggatcaggtggtcgtcattgcgggcctcaatggtgattgggaatcagaaggctacgaccgcaggcacatggacctgcccggttacactgacgcgttgatctccgcggtagccgctgcgaaccccaacacagccgtcgtcatgcaatcgggcactcctgtctgcatgccctggatcgacgaggtgcctgccctcgtacacgcctggtatggaggcaacgaaaccggaaacgccattgcagacgtgatctttggtaccgtcaacccgtctggcaagctctcgctctcgtttcccgtccgcaacgaggacaaccctgccttcctcaacttccgctccgagcgcggccgcgctctttacggcgaggatgtctacattggataccgcttttacgagaaaacgaagagggacgtcctgtttcctttcggccacggtctctcatacacgtctttcgatatcagcaacctgcaggtcaccgacgacgatgcgggtgaaaagattacgatcaaggtcgatgtcaagaacacaggcgcgctcgagggcgctcaggttgtgcaggtttacgtcagccaacgccacccgtcgattaaccggcctccgaaggagctgaaggggtttgccaaggttttgctcaagcctggcgaggtgaggcaggccaccgttcatgtgtcaaagaaatatgcggcgagtttctgggatgagctgaaggacgcgtggattatggagaaagatgagtatgatgttttggtgggcgacagtagtgctagtacgccgctgcagggaagtttcaaggtgggcgaaacttcgtggtggaaggggctctag

SEQ ID NO: 84 - protein, 832 aa, M. phaseolina
MAPIDVEDALSKLELNEKVELLSGIDFWHTKPIPRLGIPSIRTSDGPNGVRGTRFFNGVPAACFPCGTGLAATWDVDLIRDGGKLMGKEAIAKGAHVILGPTTNMQRGPLGRRGFESFSEDPFLAGAMSAATVDGIQSTGVAATIKHFVCNDQEHERQAVDSIVSERAIREIYLMPFQIAQRDAQPMAYMTAYNRVNGVHMSDNKKILQGILRDEWGFDGLVMSDWFGTYTSADSVNAGLDLEMPGPPRVRGQQTLIAHSVRKISDDTIDERVRKVLELVNKVDKLNIPENAPERSIDSPETSKALRNVAASGLVLMKNEKNVLPLKKEQSLAVIGPNAKIAAYAGGGSANLRPYYAVTPLEGISAQKSDVKYSLGAVGYRSLPVLSYLTKTKDGDRGLTARFFKEPPTDKSRKHVDEVHVEASDILLSDYKHPEITSDTFYMDLEGILTPEESGEYIFGVSVCGTAKLFIGDKLVVDNTENQRQGDTFFGSGTVEETGTMQLEAGKSYQVYLQFGSSTTSNMKTPGATVMAGGGVRVGGTKQTDPQVEIEKAVVLAKEVDQVVVIAGLNGDWESEGYDRRHMDLPGYTDALISAVAAANPNTAVVMQSGTPVCMPWIDEVPALVHAWYGGNETGNAIADVIFGTVNPSGKLSLSFPVRNEDNPAFLNFRSERGRALYGEDVYIGYRFYEKTKRDVLFPFGHGLSYTSFDISNLQVTDDDAGEKITIKVDVKNTGALEGAQVVQVYVSQRHPSINRPPKELKGFAKVLLKPGEVRQATVHVSKKYAASFWDELKDAWIMEKDEYDVLVGDSSASTPLQGSFKVGETSWWKGL

SEQ ID NO: 85 - DNA, 2807 bp, M. phaseolina
gagccatatcgccaagcacaggacatcggcatgatgtcgtgagaacatagctccgcacggcctacgccgctatataaccgtgtgagggctccgccaaaattcccgccttcaaggaaagtccgccaacttcatctttccccttgacgagccatgaggtccgctgtctacgccgtcgcctccgttctggccgctgctgccccggcatgcgccgctgagaactacacctgggccaatcctccctctgaagttccctactacggcctgagtcctcccgtctatcctacccgtacgccatcaccatttccttgtgaatcccaatctgattgtttcggcagctcaaggaaccggaaactcgtcgacagcatgggctgccgcctacgaaaaggctcgcgccctggtcgctcagctgacgcaggatgaaaagtccaatttgacgcgcggctacactggtgcttgcgttggcaacactggtgccattcctcgcctgggaatcgaacctctctgcttcgcggatgctcccgatggcatcagaggctctgatttcgtgtcggcctttccctcgcagctccaccttgcaaccacttgggataggaacttgatgtaccagtacggaaaggccctcggcgaagaatatcacgacaagggcattaatgttgctcttggccctgtcgccggcccgcttggaagaattgcgaagggcgggcgaaactgggaaggtctgctttcccagaacagtcatcttacattagttgctaatgaggttgagaataggtctaagccatgacccgtacttggccggtgtgggtatgtatgaggtcactcaagctatgcagtcggccggcgtcattgctgtcgcgaaggtgagtcgattgggccagctcttgagctgagtttccgcacgtgacggtgtctaaaacggagcacagcattttctgctcaacgagcaagaataccgacgacttccgaatcagtctgcaaccgtcccttccacaggccaagtgatcaaggagccccaaggtcaggctatctcgtcgaacgcggatgacaaaacgatccacgaactctatgcctggccattttacgatgctctcaaggcgggtgccgcatccatcatgtgcagttataacagagtcaacaactcgtacgcttgccaaaattccaagctcatgaacggcctccttaaaaccgagatgggcttcgaagggtttgtcgtcagtgactggcaaggccaacacacgggtgttgcgtctgcaaacgctggcctcgatgtcgtcatgcccgatggcggcttctggggtgccaacctcacagaggcggtcaacaacggctcggtaagtgcggagcgttttgacgacatggcaacccgtgtcctggctgcctactatctcttgaaccaagacgaagatttcccggagattggcgttttctctgataccgttgagcaccccatcgtagacgtccgcggtgaacatgacaaagtcatacgagaggtcggcactgctggccacgtacttgtcaagaatgtcaacaacgctctgccgctccagaacccgaagttcgtcgccatctacggatatgatgcggacgtcaaggcggcaccttgggaaaatgttgctcgctatggcggcggctacgaggtcaattatggttggaacacattcaatggaaccctcataaccggtggaggttccggaggcgcgtcaccgccgtatgtgatcagcccgtttaaagccatccaagatcgggttattcaagatcatggcatcgtccgctggaatttctgggatgttaatcctcatgtctcggcgactgcgcaagtttgcttggtgttcatcaacgcttacgcgtccgagagcttcgatcgcccctccctcacggatgaattcagtgacgagctggtgaagaacgtcgccactaactgctccaacaccgtcgtggttgtccattccgctggcatccgcatcgtcgatgcttggatcgagcacgagaacgtcaccgctgtcatattcgctggtctgcccggccaggagagtggtcacagtcttgtggatatcctgtacggagacgtcagtccgagcggaaagctcacctacactgtggctaagacggaggaagactacggcctccttctcaaccacacagaggacgacagctttttcccgcagagcaatttctccgaaggtatctacattgattatagagccttcgacaaggatggtattgagccacgcttcgagttcggctttggcctttcctactctgaattcgagtactccaacatcgaaatcaactccctcaatgggaacactgacgctttcccgccagaggctgccattgtacagggcggccaccctgctctgtgggacgtcctctacaacgttacggctgagatcgagaatatcggaaattatactgcccaggaggtcgcccagctctatgtcggtatccccaccggccccgtccgccagctccgtggtttcgacaaagtcgctactgagcctggccagaaggttagcgtcagcttccccttgaagcgccgtgacctgagcgtgtggaatgttgtagctcagcagtgggagttgcagtctggtgattacccgatttggatcggtgcaagcagcagggatctgagattgaacgcgaccatcacgatttaggggggaagcacctgagaagtcaatgaattttctgaacactggtcagacttaatgcgtgtacagttgatggaaataatagactaatgtcatactgactgcatcgacgtccaagcgatactttcattccacgagccccctagtttcttggag

SEQ ID NO: 86 - DNA, 2336 bp, M. phaseolina
tgaggtccgctgtctacgccgtcgcctccgttctggccgctgctgccccggcatgcgccgctgagaactacacctgggccaatcctccctctgaagttccctactacggcctgagtcctcccgtctatcctacccctcaaggaaccggaaactcgtcgacagcatgggctgccgcctacgaaaaggctcgcgccctggtcgctcagctgacgcaggatgaaaagtccaatttgacgcgcggctacactggtgcttgcgttggcaacactggtgccattcctcgcctgggaatcgaacctctctgcttcgcggatgctcccgatggcatcagaggctctgatttcgtgtcggcctttccctcgcagctccaccttgcaaccacttgggataggaacttgatgtaccagtacggaaaggccctcggcgaagaatatcacgacaagggcattaatgttgctcttggccctgtcgccggcccgcttggaagaattgcgaagggcgggcgaaactgggaaggtctaagccatgacccgtacttggccggtgtgggtatgtatgaggtcactcaagctatgcagtcggccggcgtcattgctgtcgcgaagcattttctgctcaacgagcaagaataccgacgacttccgaatcagtctgcaaccgtcccttccacaggccaagtgatcaaggagccccaaggtcaggctatctcgtcgaacgcggatgacaaaacgatccacgaactctatgcctggccattttacgatgctctcaaggcgggtgccgcatccatcatgtgcagttataacagagtcaacaactcgtacgcttgccaaaattccaagctcatgaacggcctccttaaaaccgagatgggcttcgaagggtttgtcgtcagtgactggcaaggccaacacacgggtgttgcgtctgcaaacgctggcctcgatgtcgtcatgcccgatggcggcttctggggtgccaacctcacagaggcggtcaacaacggctcggtaagtgcggagcgttttgacgacatggcaacccgtgtcctggctgcctactatctcttgaaccaagacgaagatttcccggagattggcgttttctctgataccgttgagcaccccatcgtagacgtccgcggtgaacatgacaaagtcatacgagaggtcggcactgctggccacgtacttgtcaagaatgtcaacaacgctctgccgctccagaacccgaagttcgtcgccatctacggatatgatgcggacgtcaaggcggcaccttgggaaaatgttgctcgctatggcggcggctacgaggtcaattatggttggaacacattcaatggaaccctcataaccggtggaggttccggaggcgcgtcaccgccgtatgtgatcagcccgtttaaagccatccaagatcgggttattcaagatcatggcatcgtccgctggaatttctgggatgttaatcctcatgtctcggcgactgcgcaagtttgcttggtgttcatcaacgcttacgcgtccgagagcttcgatcgcccctccctcacggatgaattcagtgacgagctggtgaagaacgtcgccactaactgctccaacaccgtcgtggttgtccattccgctggcatccgcatcgtcgatgcttggatcgagcacgagaacgtcaccgctgtcatattcgctggtctgcccggccaggagagtggtcacagtcttgtggatatcctgtacggagacgtcagtccgagcggaaagctcacctacactgtggctaagacggaggaagactacggcctccttctcaaccacacagaggacgacagctttttcccgcagagcaatttctccgaaggtatctacattgattatagagccttcgacaaggatggtattgagccacgcttcgagttcggctttggcctttcctactctgaattcgagtactccaacatcgaaatcaactccctcaatgggaacactgacgctttcccgccagaggctgccattgtacagggcggccaccctgctctgtgggacgtcctctacaacgttacggctgagatcgagaatatcggaaattatactgcccaggaggtcgcccagctctatgtcggtatccccaccggccccgtccgccagctccgtggtttcgacaaagtcgctactgagcctggccagaaggttagcgtcagcttccccttgaagcgccgtgacctgagcgtgtggaatgttgtagctcagcagtgggagttgcagtctggtgattacccgatttggatcggtgcaagcagcagggatctgagattgaacgcgaccatcacgatttag

SEQ ID NO: 87 - protein, 778 aa, M. phaseolina
MRSAVYAVASVLAAAAPACAAENYTWANPPSEVPYYGLSPPVYPTPQGTGNSSTAWAAAYEKARALVAQLTQDEKSNLTRGYTGACVGNTGAIPRLGIEPLCFADAPDGIRGSDFVSAFPSQLHLATTWDRNLMYQYGKALGEEYHDKGINVALGPVAGPLGRIAKGGRNWEGLSHDPYLAGVGMYEVTQAMQSAGVIAVAKHFLLNEQEYRRLPNQSATVPSTGQVIKEPQGQAISSNADDKTIHELYAWPFYDALKAGAASIMCSYNRVNNSYACQNSKLMNGLLKTEMGFEGFVVSDWQGQHTGVASANAGLDVVMPDGGFWGANLTEAVNNGSVSAERFDDMATRVLAAYYLLNQDEDFPEIGVFSDTVEHPIVDVRGEHDKVIREVGTAGHVLVKNVNNALPLQNPKFVAIYGYDADVKAAPWENVARYGGGYEVNYGWNTFNGTLITGGGSGGASPPYVISPFKAIQDRVIQDHGIVRWNFWDVNPHVSATAQVCLVFINAYASESFDRPSLTDEFSDELVKNVATNCSNTVVVVHSAGIRIVDAWIEHENVTAVIFAGLPGQESGHSLVDILYGDVSPSGKLTYTVAKTEEDYGLLLNHTEDDSFFPQSNFSEGIYIDYRAFDKDGIEPRFEFGFGLSYSEFEYSNIEINSLNGNTDAFPPEAAIVQGGHPALWDVLYNVTAEIENIGNYTAQEVAQLYVGIPTGPVRQLRGFDKVATEPGQKVSVSFPLKRRDLSVWNVVAQQWELQSGDYPIWIGASSRDLRLNATITI

SEQ ID NO: 88 - DNA, 2860 bp, M. phaseolina
cccttccggggacgcgtcagatggccgaagctcgaggaagtgccccatttccggacgatgagtattttataccttcatgagctctgctagtcacgattagcaaaagcacctgtctctcttttccccaggctcgagccttccactaagccaatgcgtccgtccctatccgttctccccgccctgacccttttggtccggggcctcagtgcctattccactaactacacgagtcagaatcttgcctctggcactagtgagtttccttggaatcctgaaacccatgcgcagcaaacctaagaggcattaaatgttcttgttgtctcgtggaacaatatatcttcgatcgcgttcccatgtcaactttgttcgtgtctcagcgcagaggctgaccgcgtgtagtcaaactcggcgactggcaagatgcctacgaccgcgcaaagacctttgttgatggtctcagcaattccgaaaagatttctctgatcactggctccgatgtctccaacttcactgccctttacttcagagactctggtgattccatcctccaatactactttgtgactacctggtcagtcccaaacacattgtcaccctgtcccacaattatactaacttctgcaggcccctttcatctgcccttgccatgacttgggacaagaagatgatgtaccagatgtacaaagctcttggcgacgagttctacgccaagggcatcaacgttgccaatggccccgttagtcagcctcttggccgttcgccatggggcggacgtaacggagaatccttcggtcccgattcgtacttaaacggcatcgccttcggcctctccgtcaaggggtacggagatgctggtgtcatttctggagccaagcatttccttttaaacgagcaagagaacaaccgtacccaggattcgaccggtgggggcggtggaggctctccaccaaacgatggcggcaatccgactacgcccggtagtggcgctgctccaactggcggcatgggcggtggagctagtagcgattcgtcaagctctgagtccattgcatactcttcgcaggtagacgacaagaccctgcacgagacttacatgtggccctttttcgatggcgtcaaggctggtttgggtgccgttatgtgcgctctcaaccgtgtcaacgagacctacgcctgtgagaaccaggacctaattgctggcaagctcaagagcgagatagggtttcccggcttcgtttttggtgatgttggcggccaaaagactgctttcgggtctgccaacgccggcatggactatggcagctcttcaacgtggagcaacagcaccatgctcgccgggctgaacaacggctcgttgactgaggctcgcctgaccgacatggccgtccgcaatgttctcccgtcctacaaattcaatcagcaggacggcacatatcctactaccgctggtcttgaggattacgtagacccgagggccaaccacagcaagatcgccaggagcattgctgcttcctcactggtccttttgaagaacgagaacaatgctctacccctcaaaaagcccaagtccatgtccatcttcggcgttcatgccggagcagccatcgccggacccaatgatcccatttctgtcaccggttccgacgacatctaccagggccacgccgcctcccttggtggaagcggaactggctcctttccttacctcgttactcctcactacgctttgaccaccaaagtcattgaggacggcactatgttccgctggatcatgaacgacacaggctacacctccacgagcggcggcctctctggctactcgtccggcactggtgccgcccatacctacagcggctacgccacggactccgaagtctgcatcgtcttcctcaacgcctactcgggcgagggcgcggaccgcagtgcactctacaacaccgaccaagacggcatggtcgcctcggtcgcctcggcctgcaataacaccatcgtcgtcatcaacgccgtcgccgcgcgcctcgtcgacgcgtggatcgacaacgttaacattaccgccgtcgtctatggcagcatgctgggccaagaatccggccacgccatcgtcgacgtcctctacggcgccgtaaacccgtccggcaaactcacctacaccatcgccaagaacgagtccgactacaacaccggcctttgcaccgacctcatctgcgacttctccgagggcaactacattgactacaagtacttcgacgcctacaacgtcaccccgcgctacgagttcggctacggcctctcgtacacgaccttcaagtacgcagacaccctctccgtcgcgaaaacgaacggctccgccctcgcccgcacgtacgccactggcccgctcgccgtcggcggccgcgaggacctgtgggacgtcgtcgccaccgccgagaccagcatcgccaacaccggcgagcgcgacggcgccgaggcggcgcagctgtacgtcaagtttcccgccgcggcgggccagccgctgcgccagctacgcgggttcgagaaggtgcatctggccaagggcgcggagcagaaggtgaagttcgagctgcgcaggagggatctgagttattgggatgtcgaggcgcagaattgggcggttgcgaggggcacgtatgagttcttcgtcggcgcgagtagtagggacttgaaggcgcacgcgattctaaccgtttgaggagatgggcgatgagctattgaggcgcgctgatgattggggggaaaggaggggggggggggggggggcgttgagagcgccggaatagcggtttttgcttcacttctcatatgtatacgcatctagacggtacatatctgtacaaaaatg

SEQ ID NO: 89 - DNA, 2361 bp, M. phaseolina
atgcgtccgtccctatccgttctccccgccctgacccttttggtccggggcctcagtgcctattccactaactacacgagtcagaatcttgcctctggcactatcaaactcggcgactggcaagatgcctacgaccgcgcaaagacctttgttgatggtctcagcaattccgaaaagatttctctgatcactggctccgatgtctccaacttcactgccctttacttcagagactctggtgattccatcctccaatactactttgtgactacctggcccctttcatctgcccttgccatgacttgggacaagaagatgatgtaccagatgtacaaagctcttggcgacgagttctacgccaagggcatcaacgttgccaatggccccgttagtcagcctcttggccgttcgccatggggcggacgtaacggagaatccttcggtcccgattcgtacttaaacggcatcgccttcggcctctccgtcaaggggtacggagatgctggtgtcatttctggagccaagcatttccttttaaacgagcaagagaacaaccgtacccaggattcgaccggtgggggcggtggaggctctccaccaaacgatggcggcaatccgactacgcccggtagtggcgctgctccaactggcggcatgggcggtggagctagtagcgattcgtcaagctctgagtccattgcatactcttcgcaggtagacgacaagaccctgcacgagacttacatgtggccctttttcgatggcgtcaaggctggtttgggtgccgttatgtgcgctctcaaccgtgtcaacgagacctacgcctgtgagaaccaggacctaattgctggcaagctcaagagcgagatagggtttcccggcttcgtttttggtgatgttggcggccaaaagactgctttcgggtctgccaacgccggcatggactatggcagctcttcaacgtggagcaacagcaccatgctcgccgggctgaacaacggctcgttgactgaggctcgcctgaccgacatggccgtccgcaatgttctcccgtcctacaaattcaatcagcaggacggcacatatcctactaccgctggtcttgaggattacgtagacccgagggccaaccacagcaagatcgccaggagcattgctgcttcctcactggtccttttgaagaacgagaacaatgctctacccctcaaaaagcccaagtccatgtccatcttcggcgttcatgccggagcagccatcgccggacccaatgatcccatttctgtcaccggttccgacgacatctaccagggccacgccgcctcccttggtggaagcggaactggctcctttccttacctcgttactcctcactacgctttgaccaccaaagtcattgaggacggcactatgttccgctggatcatgaacgacacaggctacacctccacgagcggcggcctctctggctactcgtccggcactggtgccgcccatacctacagcggctacgccacggactccgaagtctgcatcgtcttcctcaacgcctactcgggcgagggcgcggaccgcagtgcactctacaacaccgaccaagacggcatggtcgcctcggtcgcctcggcctgcaataacaccatcgtcgtcatcaacgccgtcgccgcgcgcctcgtcgacgcgtggatcgacaacgttaacattaccgccgtcgtctatggcagcatgctgggccaagaatccggccacgccatcgtcgacgtcctctacggcgccgtaaacccgtccggcaaactcacctacaccatcgccaagaacgagtccgactacaacaccggcctttgcaccgacctcatctgcgacttctccgagggcaactacattgactacaagtacttcgacgcctacaacgtcaccccgcgctacgagttcggctacggcctctcgtacacgaccttcaagtacgcagacaccctctccgtcgcgaaaacgaacggctccgccctcgcccgcacgtacgccactggcccgctcgccgtcggcggccgcgaggacctgtgggacgtcgtcgccaccgccgagaccagcatcgccaacaccggcgagcgcgacggcgccgaggcggcgcagctgtacgtcaagtttcccgccgcggcgggccagccgctgcgccagctacgcgggttcgagaaggtgcatctggccaagggcgcggagcagaaggtgaagttcgagctgcgcaggagggatctgagttattgggatgtcgaggcgcagaattgggcggttgcgaggggcacgtatgagttcttcgtcggcgcgagtagtagggacttgaaggcgcacgcgattctaaccgtttga

SEQ ID NO: 90 - protein, 786 aa, M. phaseolina
MRPSLSVLPALTLLVRGLSAYSTNYTSQNLASGTIKLGDWQDAYDRAKTFVDGLSNSEKISLITGSDVSNFTALYFRDSGDSILQYYFVTTWPLSSALAMTWDKKMMYQMYKALGDEFYAKGINVANGPVSQPLGRSPWGGRNGESFGPDSYLNGIAFGLSVKGYGDAGVISGAKHFLLNEQENNRTQDSTGGGGGGSPPNDGGNPTTPGSGAAPTGGMGGGASSDSSSSESIAYSSQVDDKTLHETYMWPFFDGVKAGLGAVMCALNRVNETYACENQDLIAGKLKSEIGFPGFVFGDVGGQKTAFGSANAGMDYGSSSTWSNSTMLAGLNNGSLTEARLTDMAVRNVLPSYKFNQQDGTYPTTAGLEDYVDPRANHSKIARSIAASSLVLLKNENNALPLKKPKSMSIFGVHAGAAIAGPNDPISVTGSDDIYQGHAASLGGSGTGSFPYLVTPHYALTTKVIEDGTMFRWIMNDTGYTSTSGGLSGYSSGTGAAHTYSGYATDSEVCIVFLNAYSGEGADRSALYNTDQDGMVASVASACNNTIVVINAVAARLVDAWIDNVNITAVVYGSMLGQESGHAIVDVLYGAVNPSGKLTYTIAKNESDYNTGLCTDLICDFSEGNYIDYKYFDAYNVTPRYEFGYGLSYTTFKYADTLSVAKTNGSALARTYATGPLAVGGREDLWDVVATAETSIANTGERDGAEAAQLYVKFPAAAGQPLRQLRGFEKVHLAKGAEQKVKFELRRRDLSYWDVEAQNWAVARGTYEFFVGASSRDLKAHAILTV

SEQ ID NO: 91 - DNA, 2205 bp, M. phaseolina
tttaccgacgctgggggctcgggtaatccgcgaaggcacgtttactatgcatataaagacggctgccggcattggttcaacatgtgctgcagagcttttggacgcaggccaggtctctcttaacccaccgctgccagtcactgctccaagatgcggacacccgttctccacacctcaactaccaagccgcagggctcatgggcttccatctttgtggcagccctggcctcgatctctgctgtctcagcaagagcattacccaggggcgctgctcagaacgagaccgtcccggcctaccgcaaccctaccctctgcatcgatgagcgtctggacgacttgatccagcgcatgaccctggaggagaaggcaggacagcttttcattaagcagattcccatgggaacgaatggcacgatcgacatcgagacaaaaaccgacaactacacttccgccgacctcatcagccagaagctcatgtcccacttcaacctgcaatccagcggcaaggccagcgacattgcaaactggcacaacagcatccaggagctggctctgcagactcggctcggaataccgatcacgatagccacggacccgcgccactccttcgccgaaaccgcaggatccgctgtcggcgtcggttcattctcgcaatggcccgagacgctgggcttggccgcgttaaggagtccagagcttgtacagcgcttcgctgagattgcgcgtgaggagtacatggccgtcggcatccggtctgcgcttagcccgcagatcgatgtcaccacggagccgcgctgggcacgctccggacagacgtacggagaagacgcaaacctgaccagctccctggttgttggttacctcaagggcttccagggcgagactcttggccgccactccgtcaccacggtcacgaagcatttccccggcggtgggcctggccaaaatggcaatgactcgcacttcgagactggaaagaacaatgtctaccccggaggctactttgactaccacctggagccgttcagagctgccatcgctgccggtgctagacagatgatgccttcctatgcccggccgatcggaaccaagtatgaggaggtcgccatgggctttaacaagggcatcgtaacagatctcctgcgcgacgaactcggcttcgacggcatcgtcgttagcgattggggtctagtcactaacttcaccgcgcgcggcgaggagatggaggccatctcgtggggcgtggagaacctgagcgaaatcgaaaaggttgagaagatcctcaacgccggcgtcgaccagctcggcggcgagatccggactgagcttgtcatccagctcgtcaacgagggtgccatctcagaggagcgcatcgacgtctcggtgcgccggctgctgcgcgagaagttcgtgctcggcctcttcgacaaccccttcgtcgacccggatgcggctgacgctatcgtcggcaatgattacttccgccgcgtcggcaacgagactcagcgccgcgcctacaccctgctcaagaatgacgacgacctcctgcctctgacgctcgacgccgacaccaagttctatgccgacggcttcaacgcatcgtacctgctcgagcgcggcctcgccgtcgtcgacacccctgaggaggccgactacgcgttcctgcgcctctccaccccctatgaggcccgtggtggcggcttcgagcgcaactaccatcaaggacgcctcgatttcaacgagactgagaaggctcgccacgccgccatcacgcaaaccgtcccgaccatcgttgacatctacctcgaccgcccagccgtcatccccgagctcgccgaggactcggccgcgctgctcggcaactacggcgccagcgttgatgcgttcctggatatcgtgttcggcacggagggttggaagcccgagggcaagctgccgttcgatctgcccaggtcgatggaggcggtggaggcgaataaggaagatgtgccctttgatactgagaatcccgtgttccggtatgggcatgggttaagctatgcggagaagtgttgaacgtgaaggagttgatgacttaacgtaatgtaacgagcaaaaatttttttatcagaaatcagaccttttgttcgcgattgggggctcgaaatgccaccatatcacactaacgctacattcagaatgaatttgtgcgacgataaaacatgc

SEQ ID NO: 92 - DNA, 1905 bp, M. phaseolina
atgcggacacccgttctccacacctcaactaccaagccgcagggctcatgggcttccatctttgtggcagccctggcctcgatctctgctgtctcagcaagagcattacccaggggcgctgctcagaacgagaccgtcccggcctaccgcaaccctaccctctgcatcgatgagcgtctggacgacttgatccagcgcatgaccctggaggagaaggcaggacagcttttcattaagcagattcccatgggaacgaatggcacgatcgacatcgagacaaaaaccgacaactacacttccgccgacctcatcagccagaagctcatgtcccacttcaacctgcaatccagcggcaaggccagcgacattgcaaactggcacaacagcatccaggagctggctctgcagactcggctcggaataccgatcacgatagccacggacccgcgccactccttcgccgaaaccgcaggatccgctgtcggcgtcggttcattctcgcaatggcccgagacgctgggcttggccgcgttaaggagtccagagcttgtacagcgcttcgctgagattgcgcgtgaggagtacatggccgtcggcatccggtctgcgcttagcccgcagatcgatgtcaccacggagccgcgctgggcacgctccggacagacgtacggagaagacgcaaacctgaccagctccctggttgttggttacctcaagggcttccagggcgagactcttggccgccactccgtcaccacggtcacgaagcatttccccggcggtgggcctggccaaaatggcaatgactcgcacttcgagactggaaagaacaatgtctaccccggaggctactttgactaccacctggagccgttcagagctgccatcgctgccggtgctagacagatgatgccttcctatgcccggccgatcggaaccaagtatgaggaggtcgccatgggctttaacaagggcatcgtaacagatctcctgcgcgacgaactcggcttcgacggcatcgtcgttagcgattggggtctagtcactaacttcaccgcgcgcggcgaggagatggaggccatctcgtggggcgtggagaacctgagcgaaatcgaaaaggttgagaagatcctcaacgccggcgtcgaccagctcggcggcgagatccggactgagcttgtcatccagctcgtcaacgagggtgccatctcagaggagcgcatcgacgtctcggtgcgccggctgctgcgcgagaagttcgtgctcggcctcttcgacaaccccttcgtcgacccggatgcggctgacgctatcgtcggcaatgattacttccgccgcgtcggcaacgagactcagcgccgcgcctacaccctgctcaagaatgacgacgacctcctgcctctgacgctcgacgccgacaccaagttctatgccgacggcttcaacgcatcgtacctgctcgagcgcggcctcgccgtcgtcgacacccctgaggaggccgactacgcgttcctgcgcctctccaccccctatgaggcccgtggtggcggcttcgagcgcaactaccatcaaggacgcctcgatttcaacgagactgagaaggctcgccacgccgccatcacgcaaaccgtcccgaccatcgttgacatctacctcgaccgcccagccgtcatccccgagctcgccgaggactcggccgcgctgctcggcaactacggcgccagcgttgatgcgttcctggatatcgtgttcggcacggagggttggaagcccgagggcaagctgccgttcgatctgcccaggtcgatggaggcggtggaggcgaataaggaagatgtgccctttgatactgagaatcccgtgttccggtatgggcatgggttaagctatgcggagaagtgttga

SEQ ID NO: 93 - protein, 634 aa, M. phaseolina
MRTPVLHTSTTKPQGSWASIFVAALASISAVSARALPRGAAQNETVPAYRNPTLCIDERLDDLIQRMTLEEKAGQLFIKQIPMGTNGTIDIETKTDNYTSADLISQKLMSHFNLQSSGKASDIANWHNSIQELALQTRLGIPITIATDPRHSFAETAGSAVGVGSFSQWPETLGLAALRSPELVQRFAEIAREEYMAVGIRSALSPQIDVTTEPRWARSGQTYGEDANLTSSLVVGYLKGFQGETLGRHSVTTVTKHFPGGGPGQNGNDSHFETGKNNVYPGGYFDYHLEPFRAAIAAGARQMMPSYARPIGTKYEEVAMGFNKGIVTDLLRDELGFDGIVVSDWGLVTNFTARGEEMEAISWGVENLSEIEKVEKILNAGVDQLGGEIRTELVIQLVNEGAISEERIDVSVRRLLREKFVLGLFDNPFVDPDAADAIVGNDYFRRVGNETQRRAYTLLKNDDDLLPLTLDADTKFYADGFNASYLLERGLAVVDTPEEADYAFLRLSTPYEARGGGFERNYHQGRLDFNETEKARHAAITQTVPTIVDIYLDRPAVIPELAEDSAALLGNYGASVDAFLDIVFGTEGWKPEGKLPFDLPRSMEAVEANKEDVPFDTENPVFRYGHGLSYAEKC

SEQ ID NO: 94 - DNA, 2271 bp, M. phaseolina
ctctgggcaagggacagggaatgcatttaggccgatattgggggactcgcctctctcacataaatatgccttccgcccgcctccatcagggcctcagggacccacggactccgctcaccaggcctcaatccccgcacgcacgagttcgccatgtcctcctccctcgtcctcccggtgcttctggcctcgacctccttggtcggagcccaattgacttttggcaccccggccggcaattactccaccaagacatactccgtccccgccatcgagactgagtaccgccccaacaccgactactcggacaaggccctcgccttcctgtgggaccaggtcggccctatctccaccggccccgtgactacgactgtcgagcccacgccggagcccagtctgtatcctcagccaggccccatccacccgctcattcccagctatgatcggaacttgactggtctgaagctgcccaagggcttcaagtggggagtctcgtcctcttcataccagatagagggagcggccgatgcagaaggtaaaggtccgtccatttgggacttgctctcccatcgcgtccccaatttcgttgcggacaacacgacgggagatgttgtggcgagccactactggttgtacaagcaggactttgcccggctcaaggcactgggcatccccgcattcagccccagtatcagctggccgcgtctgttcccgttcggcaagggccctgtaaaccagcaggccgtggcccattacgatgatgttatatctgagctagtgaagaacgggatcaagcccaagattacgctcttccactgggatacgccgctggcgctcttcaatgagtacggcgcgtggacttcgaggaacgttgttgatgatttcgtcaactatgcaaagtttgtcatttctcggtacgatgcgtacgttgaggattggttcactatcaatgagccgcaatactgcgattggcaatactctctctaccctgcgggcgaagtaagttaaaggccctccgcaccagccgcgtccccgcccgaacccctcaccaccacacccacagcatcactgctacatcattgtttcagaagcagcagttacggctccctaacaacgtccagtattatcctgcttatcagaattataccggagggttgccgacgcgctttatttgcggtcattacacccttctggcgcacgcgaaggtggttgactggtaagtttagctctcccctgaacggtggaatacaaagatggctgacacatgtggacctgaaaaggtatagaaacgaattcaaggtgcctacgatctgtgaaagtccatatgcgttgctaataactaacactccatagggcaccggcaaaatcacattcaagaactcgggcaactacttccagcccaatacttcctccgaggcagatgccattgctacgcagcgtaactacgacttcgttctcggctggtttggtggtccatggacggacggtgattatcctcaatccctaaaggacaccctgggggatatccttccagagtttacgcaagaagaaaaagacctcatcaagggctcctgcgactacttcgcaatcgacggatattcctcgttcactgcgtacgctcttccgcaggaggagtacgagaactgtatcaccaactcctctcacccgtcctacccaacttgcgccggaagcgttggcctggcgactgacggcttcccgctcgccccggccgccgaccaaggtgtctcatggctcatcgatgcccctcaaggcctacgccgcttcctttctaaaattaccaaggagctcttcccgtcggtcaacgagattgccgtcaccgagttcggtttcgccgagcccttcgaatcccagctcgacagcctgcaaaccatcctctgggatctgcgccgcgccgactacttccagtcgtacctagacgccatcttgcaagccattcattatgatggcgtcaatgtgactggcgcctggggctgggccatcttcgataactttgagtggcttgtcggcctcggcactcgcttcggtctgcagtatgtgaattacactgacttgacgaggacgcccaaagctagcgtattccagtttgtgaactggttcaagtaagtctccatatcattgacgttttgtagtgcacgaacatgaactgactttttgtattagagagcatgaggatctggacgagccgtccaataccactatgaggttgttctagagagagagagagagtcctcgtattagagtagcgtatggaac

SEQ ID NO: 95 - DNA, 1731 bp, M. phaseolina
atgtcctcctccctcgtcctcccggtgcttctggcctcgacctccttggtcggagcccaattgacttttggcaccccggccggcaattactccaccaagacatactccgtccccgccatcgagactgagtaccgccccaacaccgactactcggacaaggccctcgccttcctgtgggaccaggtcggccctatctccaccggccccgtgactacgactgtcgagcccacgccggagcccagtctgtatcctcagccaggccccatccacccgctcattcccagctatgatcggaacttgactggtctgaagctgcccaagggcttcaagtggggagtctcgtcctcttcataccagatagagggagcggccgatgcagaaggtaaaggtccgtccatttgggacttgctctcccatcgcgtccccaatttcgttgcggacaacacgacgggagatgttgtggcgagccactactggttgtacaagcaggactttgcccggctcaaggcactgggcatccccgcattcagccccagtatcagctggccgcgtctgttcccgttcggcaagggccctgtaaaccagcaggccgtggcccattacgatgatgttatatctgagctagtgaagaacgggatcaagcccaagattacgctcttccactgggatacgccgctggcgctcttcaatgagtacggcgcgtggacttcgaggaacgttgttgatgatttcgtcaactatgcaaagtttgtcatttctcggtacgatgcgtacgttgaggattggttcactatcaatgagccgcaatactgcgattggcaatactctctctaccctgcgggcgaatattatcctgcttatcagaattataccggagggttgccgacgcgctttatttgcggtcattacacccttctggcgcacgcgaaggtggttgactggtatagaaacgaattcaagggcaccggcaaaatcacattcaagaactcgggcaactacttccagcccaatacttcctccgaggcagatgccattgctacgcagcgtaactacgacttcgttctcggctggtttggtggtccatggacggacggtgattatcctcaatccctaaaggacaccctgggggatatccttccagagtttacgcaagaagaaaaagacctcatcaagggctcctgcgactacttcgcaatcgacggatattcctcgttcactgcgtacgctcttccgcaggaggagtacgagaactgtatcaccaactcctctcacccgtcctacccaacttgcgccggaagcgttggcctggcgactgacggcttcccgctcgccccggccgccgaccaaggtgtctcatggctcatcgatgcccctcaaggcctacgccgcttcctttctaaaattaccaaggagctcttcccgtcggtcaacgagattgccgtcaccgagttcggtttcgccgagcccttcgaatcccagctcgacagcctgcaaaccatcctctgggatctgcgccgcgccgactacttccagtcgtacctagacgccatcttgcaagccattcattatgatggcgtcaatgtgactggcgcctggggctgggccatcttcgataactttgagtggcttgtcggcctcggcactcgcttcggtctgcagtatgtgaattacactgacttgacgaggacgcccaaagctagcgtattccagtttgtgaactggttcaagtaa

SEQ ID NO: 96 - protein, 576 aa, M. phaseolina
MSSSLVLPVLLASTSLVGAQLTFGTPAGNYSTKTYSVPAIETEYRPNTDYSDKALAFLWDQVGPISTGPVTTTVEPTPEPSLYPQPGPIHPLIPSYDRNLTGLKLPKGFKWGVSSSSYQIEGAADAEGKGPSIWDLLSHRVPNFVADNTTGDVVASHYWLYKQDFARLKALGIPAFSPSISWPRLFPFGKGPVNQQAVAHYDDVISELVKNGIKPKITLFHWDTPLALFNEYGAWTSRNVVDDFVNYAKFVISRYDAYVEDWFTINEPQYCDWQYSLYPAGEYYPAYQNYTGGLPTRFICGHYTLLAHAKVVDWYRNEFKGTGKITFKNSGNYFQPNTSSEADAIATQRNYDFVLGWFGGPWTDGDYPQSLKDTLGDILPEFTQEEKDLIKGSCDYFAIDGYSSFTAYALPQEEYENCITNSSHPSYPTCAGSVGLATDGFPLAPAADQGVSWLIDAPQGLRRFLSKITKELFPSVNEIAVTEFGFAEPFESQLDSLQTILWDLRRADYFQSYLDAILQAIHYDGVNVTGAWGWAIFDNFEWLVGLGTRFGLQYVNYTDLTRTPKASVFQFVNWFK

SEQ ID NO: 97 - DNA, 2298 bp, M. phaseolina
agcgccgcataagaagcgccagcgcccgcctcgcctctgctcacatcttccgtgaaacctggcctttggagcatcactggaaaagtaccagtgcgacactagtggcacgaacatttttcagcaacgaggacagaacgagagacaaccgagatggcagaggcagtacttccgaaggatttcctctggggctttgcaacagcaaggtctgctcccctttctcctgaaagcttcctccttatgatgtcgttgttcctgcgtcggcagccggagagagagataagcttaccttcatttacttacactccctagctaccaaatcgaaggtgctccgaacgaggacggccgtgctgatagcatctgggataccttctgccgcaagcccggcaagatcgccgacgccagcagcggcgatgttgcctgcgactcgtaccaccgaactgctgaagacattgccctcctaaagcagtgtcgcgccaaagcctatcgcttctccctctcctggtcccggattatccccttgggcggccggaatgatccagtcaacgaaaagggcctccagcactacgtgaaacttgccgacgacctgattgccgccggtatcacgccgatggtgactctgtaccactgggaccttccggacgagttggacaagcggtacggtggacttctgaataaggaggaatttgtggccgactacgttcactacgctagggtcgtgttcaaagcgtttggcagcagggtcaagtactggatcaccttcaacgagccatggtgcagctcgatcctcggctacagcaccggcctgttcgcgccgggcaggacgagtaaccgcagcaagaatcccgagggagacagttcgagggagccatggatcgtcggacacaatctcctgattgcccatgcttcggccgtcaaggtgtatcgagaagagttcaaggcgaaggacggtggtcagattggcatcactctgaacggtgagctgaaacttccaaaaatacttcaaacaccacgtactagcaagcgggattgcactaaggggtgagatgaaccttgtgctgccgatcattcgcctggaccttcggtcagactcgggttggacactgcgtgccgtcgctgtggccgggtgcttcgggcctatacaaagctagtctggacgacatgttcttttgagtttggaagtcgacaggcccgttcccgcgtgcatcccttcttgtctcatggtgtgatcagatgcagctcgaccatcgctaacatgtccggcaggggattacatgtatccttgggaccctgaagacccgcgtgatgtcgaagctgccaaccgcaagcatgagttctccatctcctggtttgcggatccagtctacttcggcaagtatcctgacagcatgcgcaagcagcttggcgaccgtctgccggaattcaccgcggacgaagcagcgctgatcaagggtagcaacgatttctacggcatgaaccactataccgcaaactacgtgaagcacgtcgacacagagcccgccgaggacgatttccttggaaacctcgagtgcaccttctacagcaagaaaggcgagtgcatcggcccagagacacagagcccatggctcaggccgaacgggctggggttcaggaagctgctgaaatggataaggttcgtttcgccggaaactctattgggcctggttccgcgacgggagggaaagccgcgcttgggaaaccactaacatctgtgacatcagtgaccgctacggacgtcctaccatctacgttacggagaacggaacgagcctgaagggggagaacgaccttcctctggaacagctgctggaagatgatttccgggtcaagtacttcgacgactacatccatgcgctcgcggatgcgtacagcaaggacaatgtcgacgttcgaggctacatggcttggtcactcatggagtaagcaacgcccagtgttgacgcacagtgccatccggtgggattccgcgaggctgaccaaactccccgcagtaatttcgagtgggcggagggatacgagacgcgctttggcgtgtgctacgtcgactacaaagggggccaaaagcgatatcccaagaagagcgccagggctattggtgagatcttcgatgcgctgatgaggaaggactagcttgggcggatggcgattggccaaatgagattgcgagcaggttttcggcggacgttccatcggggcagggcaggggaaaagggggccatgctggcacggcaaatgtcagtagcgcatgtcgactgccgtgccgggagttgaagacgtcaa

SEQ ID NO: 98 - DNA, 1443 bp, M. phaseolina
atggcagaggcagtacttccgaaggatttcctctggggctttgcaacagcaagctaccaaatcgaaggtgctccgaacgaggacggccgtgctgatagcatctgggataccttctgccgcaagcccggcaagatcgccgacgccagcagcggcgatgttgcctgcgactcgtaccaccgaactgctgaagacattgccctcctaaagcagtgtcgcgccaaagcctatcgcttctccctctcctggtcccggattatccccttgggcggccggaatgatccagtcaacgaaaagggcctccagcactacgtgaaacttgccgacgacctgattgccgccggtatcacgccgatggtgactctgtaccactgggaccttccggacgagttggacaagcggtacggtggacttctgaataaggaggaatttgtggccgactacgttcactacgctagggtcgtgttcaaagcgtttggcagcagggtcaagtactggatcaccttcaacgagccatggtgcagctcgatcctcggctacagcaccggcctgttcgcgccgggcaggacgagtaaccgcagcaagaatcccgagggagacagttcgagggagccatggatcgtcggacacaatctcctgattgcccatgcttcggccgtcaaggtgtatcgagaagagttcaaggcgaaggacggtggtcagattggcatcactctgaacggggattacatgtatccttgggaccctgaagacccgcgtgatgtcgaagctgccaaccgcaagcatgagttctccatctcctggtttgcggatccagtctacttcggcaagtatcctgacagcatgcgcaagcagcttggcgaccgtctgccggaattcaccgcggacgaagcagcgctgatcaagggtagcaacgatttctacggcatgaaccactataccgcaaactacgtgaagcacgtcgacacagagcccgccgaggacgatttccttggaaacctcgagtgcaccttctacagcaagaaaggcgagtgcatcggcccagagacacagagcccatggctcaggccgaacgggctggggttcaggaagctgctgaaatggataagtgaccgctacggacgtcctaccatctacgttacggagaacggaacgagcctgaagggggagaacgaccttcctctggaacagctgctggaagatgatttccgggtcaagtacttcgacgactacatccatgcgctcgcggatgcgtacagcaaggacaatgtcgacgttcgaggctacatggcttggtcactcatggataatttcgagtgggcggagggatacgagacgcgctttggcgtgtgctacgtcgactacaaagggggccaaaagcgatatcccaagaagagcgccagggctattggtgagatcttcgatgcgctgatgaggaaggactag

SEQ ID NO: 99 - protein, 480 aa, M. phaseolina
MAEAVLPKDFLWGFATASYQIEGAPNEDGRADSIWDTFCRKPGKIADASSGDVACDSYHRTAEDIALLKQCRAKAYRFSLSWSRIIPLGGRNDPVNEKGLQHYVKLADDLIAAGITPMVTLYHWDLPDELDKRYGGLLNKEEFVADYVHYARVVFKAFGSRVKYWITFNEPWCSSILGYSTGLFAPGRTSNRSKNPEGDSSREPWIVGHNLLIAHASAVKVYREEFKAKDGGQIGITLNGDYMYPWDPEDPRDVEAANRKHEFSISWFADPVYFGKYPDSMRKQLGDRLPEFTADEAALIKGSNDFYGMNHYTANYVKHVDTEPAEDDFLGNLECTFYSKKGECIGPETQSPWLRPNGLGFRKLLKWISDRYGRPTIYVTENGTSLKGENDLPLEQLLEDDFRVKYFDDYIHALADAYSKDNVDVRGYMAWSLMDNFEWAEGYETRFGVCYVDYKGGQKRYPKKSARAIGEIFDALMRKD

SEQ ID NO: 100 - DNA, 2257 bp, M. phaseolina
tgctcctcgctcatttgccgtgctcggtttgctcggcgagcactctatataatgaagttcttaaccgtattttctactcttaactgcatcggcgcttatgcgcagacgccagtatggcccataagcagctctaccagctccaatccggctatggttacgtcgatggatctgacagttgatggtaagctgtctggtagccctttgcttcaccattccaagcattgacccaaccctttgagatctgtgggacatctggatcggctctgtagcggtagcttccatcaacacgaccgtctctccaacgccggtgccaagtgccgagctgatcccacctccaccgttgcactacccgtcgtggatgacaggacatcagactcctttggcgcagaagaatgaatcttggaaatttcccaggaatttctggtggggcgttgccagtgcctcgtatcaggttgaaggcgcggtcaaggatgaagggcgagcaccatcagtgtgggatgccctgctgcacaatgttgttgactacagcttgtacaatgagacaggtgatgttgccaataaccattattatctgtacaagcaaggtaagcttacgcagaaaagttgattgtcttgaagagctgagcactgactttgttatgccagacatcgcgaggcttgccgccatgggtgtgccgtactacagcttctctctttcctggtcacgaattctaccttttgggcgcgggcctgtgaacgaggcaggattggcgcattacgaggacgtgattaaaacatgcttggaatacggtgtcaagcctgctgtgaccctgtaggttcctcgatccacctacgcccgcggattcactaacgtccttaagcttccactgggatctgcctctttatctttacaatttatacggtgtgtgatctcatccttgcctgtgcttcccccaagtggtaattagctctcttcaggtggctggacaaacgaacagatagtggatgatttcgtcaactacgcacgcatcgtcttcgagagatacggcaacaaagtccctatgtggttcactgtcaatgaaccaatcagcttctggtaatactctggtgcttgggtactctggtattggctttccctgacgccgtttcagtactctgcaaatgcccgagcactacttccgcagagttcctatcccgcaaaagcagcagccctatttctgcggccaacacgtcctcctcgcccatagcaaagtgtaccatctggccaaatctatgaatctgaccggccccatcacacttaagaacaacggttactacaagacccctctcaccaactcaacagacgacgccatcgccacgcagcgagcctgggacttcaacgaaggctggtttgccaatcccgtcttcatcgacggcgagtacccacggtatctgaaagactacgttgcaaccttcctgcgcaacctgaccacggaggaaaaagccgcaatccacggctcggctgatttctttgcgcacgacgcatacgcggcgaagtactgcttcccctcgttcccatccctttacgtctgcaagccgctaacgcaaaacccgcaggttctacatggcgccggatgcgggcatcgacgcttgcctggccaactactcgcacccgctcttccccacctgcgccaacagcaccttcacgctcgcgccctccgacggcggctggctgatcggccccgccgccgacccctacacctcctggctgcacaaagcgaccgactggatcccagccttcatgcgctacatcgacgccacctggaagcctgcgggcggcatcgccgtttccgagttcggtttcaccgagcccttcgagcacgacaagaagctcctgggcgacatccgcgctgatctggggcgggtgacgtattacaaggagtacctggcggcgctgttgctggcgatgagcgagggagtaaagattattggggtgctggcgtggacgattacggataatttggaatggacggccgggttcggagtcaagttcgggctgcagtacgtgaatttgacgacccaggagaggcactataaggcgagtttctttgagttgaagaatatgattgagatgtataaggagaactaggacgcaaaggaaagtttgtcaaaataatggagagaaaacggtggaaggaatgtttctgggggcctaccaggcggaaggtatagagtctcgacctgatgctactatgcaatgaaggactgaatgagagattgatcttatttcgcatttttt

SEQ ID NO: 101 - DNA, 1617 bp, M. phaseolina
atggttacgtcgatggatctgacagttgatgatctgtgggacatctggatcggctctgtagcggtagcttccatcaacacgaccgtctctccaacgccggtgccaagtgccgagctgatcccacctccaccgttgcactacccgtcgtggatgacaggacatcagactcctttggcgcagaagaatgaatcttggaaatttcccaggaatttctggtggggcgttgccagtgcctcgtatcaggttgaaggcgcggtcaaggatgaagggcgagcaccatcagtgtgggatgccctgctgcacaatgttgttgactacagcttgtacaatgagacaggtgatgttgccaataaccattattatctgtacaagcaagacatcgcgaggcttgccgccatgggtgtgccgtactacagcttctctctttcctggtcacgaattctaccttttgggcgcgggcctgtgaacgaggcaggattggcgcattacgaggacgtgattaaaacatgcttggaatacggtgtcaagcctgctgtgaccctcttccactgggatctgcctctttatctttacaatttatacggtggctggacaaacgaacagatagtggatgatttcgtcaactacgcacgcatcgtcttcgagagatacggcaacaaagtccctatgtggttcactgtcaatgaaccaatcagcttctgtactctgcaaatgcccgagcactacttccgcagagttcctatcccgcaaaagcagcagccctatttctgcggccaacacgtcctcctcgcccatagcaaagtgtaccatctggccaaatctatgaatctgaccggccccatcacacttaagaacaacggttactacaagacccctctcaccaactcaacagacgacgccatcgccacgcagcgagcctgggacttcaacgaaggctggtttgccaatcccgtcttcatcgacggcgagtacccacggtatctgaaagactacgttgcaaccttcctgcgcaacctgaccacggaggaaaaagccgcaatccacggctcggctgatttctttgcgcacgacgcatacgcggcgaagttctacatggcgccggatgcgggcatcgacgcttgcctggccaactactcgcacccgctcttccccacctgcgccaacagcaccttcacgctcgcgccctccgacggcggctggctgatcggccccgccgccgacccctacacctcctggctgcacaaagcgaccgactggatcccagccttcatgcgctacatcgacgccacctggaagcctgcgggcggcatcgccgtttccgagttcggtttcaccgagcccttcgagcacgacaagaagctcctgggcgacatccgcgctgatctggggcgggtgacgtattacaaggagtacctggcggcgctgttgctggcgatgagcgagggagtaaagattattggggtgctggcgtggacgattacggataatttggaatggacggccgggttcggagtcaagttcgggctgcagtacgtgaatttgacgacccaggagaggcactataaggcgagtttctttgagttgaagaatatgattgagatgtataaggagaactag

SEQ ID NO: 102 - protein, 538 aa, M. phaseolina
MVTSMDLTVDDLWDIWIGSVAVASINTTVSPTPVPSAELIPPPPLHYPSWMTGHQTPLAQKNESWKFPRNFWWGVASASYQVEGAVKDEGRAPSVWDALLHNVVDYSLYNETGDVANNHYYLYKQDIARLAAMGVPYYSFSLSWSRILPFGRGPVNEAGLAHYEDVIKTCLEYGVKPAVTLFHWDLPLYLYNLYGGWTNEQIVDDFVNYARIVFERYGNKVPMWFTVNEPISFCTLQMPEHYFRRVPIPQKQQPYFCGQHVLLAHSKVYHLAKSMNLTGPITLKNNGYYKTPLTNSTDDAIATQRAWDFNEGWFANPVFIDGEYPRYLKDYVATFLRNLTTEEKAAIHGSADFFAHDAYAAKFYMAPDAGIDACLANYSHPLFPTCANSTFTLAPSDGGWLIGPAADPYTSWLHKATDWIPAFMRYIDATWKPAGGIAVSEFGFTEPFEHDKKLLGDIRADLGRVTYYKEYLAALLLAMSEGVKIIGVLAWTITDNLEWTAGFGVKFGLQYVNLTTQERHYKASFFELKNMIEMYKEN

SEQ ID NO: 103 - DNA, 2229 bp, M. phaseolina
gctgtgacggccatgtcgccttcggtagtctccgcttctaaggcgtttagcctgttcaagaacaggaggagcagctcttgcaccatccattgcttgtgcttataaagtccgcctctctagctgtggaaaggttcgtcactataacaaaccatgttttcccttttggtgctgagttgtggtgctgtggcactcgcccaacaggtctatatctctgccgacggaccaatcccccgaccgcagtgctcagcaagccaaacctactcggccacttatgccactccgacctacgcgttcagcaacttctccttcacacaaaccgagactgtcagaacagctacgtcgatcaagtcggcgccaatcaccacatatgccccgccatacgagtctctcagtcacctggttccaaacttgagcacaaccacatggggcaattggtatcccaatgcgaccacgacagctgccgatacgaccgacccttatggacaagctgcatggtcagcgctttgggagcatgccagccttgcaaacttcacctttagggggctgtactcaacgaccgtatctccgaccccggtgcctactagtgaactcgttctgccacccccggaatattttgtcccgcaggattgctactccttcccggataccttcatgtttggagttgcgggatccgcctctcagatcgagggagccattgcagatgaaggaagaacgccttctttgatggaagttctcattcctccttcgtcaggcaagccaaccaactacgtcaccaacgagaactactacctatacaagcaagacatcgagcgtttggctgctatgggcgtcaagtactactccttgtccatcccgtggactcgcatcctgccgttcgttgttgagggatctccggtcaacaagcaaggcctcgatcattacgatgacctcatcaactttgttctttcgcgcgggatggtcccaaccgtgacgctgttgcacttcgatacgccacttcagttctacggggacaacattacatccgctgccgatcccccgcttatcggctatacgaacggagcatatcagaacgagacctttgaggatgcgttcgtgaactatggaaaaattgtcatgactcatttcgcagaccgtgtcccggtttggttcacgttcaacgagccattgctctacagctacaatggcaagagtgtggacacggtcatcaaagcacacgcaaggctctaccacttctatcatgaggagatcaatggcaccggccaagtcggcatcaagttcaacgacaacttcggtgtcccgcttgatcccacgaattcgtcagatgtcgaggcggcaaatcatttcaatgacttccagctcgccacttttgccaacccaatcttccttggcaaggactatccagaagcattcaaaatcaccattcccgactacgttcccctcactgacgaggacctggagtatatcggaggcacatccggtaagtctcggccagccgctgctgatcgggcgcggtcgaacaatgaacgaatgctcactgctgtagatttcctggggattgatccctacacggcaacggtcgtcacgcctgctccaaatggtattgctgtctgcgcatccaacacttcggatccgcttttcccctactgcgtcgagcaatctactttgaccagcgccggttggaacattggctaccgctcccaaagctacgtctacatcacgcccaaatacctgcgcacgtacctgtcatacctctggaataccttccgacacccggtcctgatcacggagtttgggttcccggtcttcggcgaggcggacaaggaagacctctcagatcaactgtatgacttcccgcgcagtaattattacctttccttcatgagcgaggtgctcaaggctatatgggaggacaaagtccatgtcctgggtgcgtttgcttggagctttgcggacaactgggaattcggtgattacgacgcgcactttggcattcagacggtcaatcgcaccacgcaggagaggcggtacaagaagagtttcttcgacttggttgattttgttgccgcgaggtcgaactagtgtgcggtgagtagccgccatcttgccaaaccggacaagacgtataattcataatggtattgagaggagcgcatgggcttcgatcggagcgagatggctccacacagacatgcattcagagacgcagtgacagatggtctgtgagtgaag

SEQ ID NO: 104 - DNA, 1863 bp, M. phaseolina
atgttttcccttttggtgctgagttgtggtgctgtggcactcgcccaacaggtctatatctctgccgacggaccaatcccccgaccgcagtgctcagcaagccaaacctactcggccacttatgccactccgacctacgcgttcagcaacttctccttcacacaaaccgagactgtcagaacagctacgtcgatcaagtcggcgccaatcaccacatatgccccgccatacgagtctctcagtcacctggttccaaacttgagcacaaccacatggggcaattggtatcccaatgcgaccacgacagctgccgatacgaccgacccttatggacaagctgcatggtcagcgctttgggagcatgccagccttgcaaacttcacctttagggggctgtactcaacgaccgtatctccgaccccggtgcctactagtgaactcgttctgccacccccggaatattttgtcccgcaggattgctactccttcccggataccttcatgtttggagttgcgggatccgcctctcagatcgagggagccattgcagatgaaggaagaacgccttctttgatggaagttctcattcctccttcgtcaggcaagccaaccaactacgtcaccaacgagaactactacctatacaagcaagacatcgagcgtttggctgctatgggcgtcaagtactactccttgtccatcccgtggactcgcatcctgccgttcgttgttgagggatctccggtcaacaagcaaggcctcgatcattacgatgacctcatcaactttgttctttcgcgcgggatggtcccaaccgtgacgctgttgcacttcgatacgccacttcagttctacggggacaacattacatccgctgccgatcccccgcttatcggctatacgaacggagcatatcagaacgagacctttgaggatgcgttcgtgaactatggaaaaattgtcatgactcatttcgcagaccgtgtcccggtttggttcacgttcaacgagccattgctctacagctacaatggcaagagtgtggacacggtcatcaaagcacacgcaaggctctaccacttctatcatgaggagatcaatggcaccggccaagtcggcatcaagttcaacgacaacttcggtgtcccgcttgatcccacgaattcgtcagatgtcgaggcggcaaatcatttcaatgacttccagctcgccacttttgccaacccaatcttccttggcaaggactatccagaagcattcaaaatcaccattcccgactacgttcccctcactgacgaggacctggagtatatcggaggcacatccgatttcctggggattgatccctacacggcaacggtcgtcacgcctgctccaaatggtattgctgtctgcgcatccaacacttcggatccgcttttcccctactgcgtcgagcaatctactttgaccagcgccggttggaacattggctaccgctcccaaagctacgtctacatcacgcccaaatacctgcgcacgtacctgtcatacctctggaataccttccgacacccggtcctgatcacggagtttgggttcccggtcttcggcgaggcggacaaggaagacctctcagatcaactgtatgacttcccgcgcagtaattattacctttccttcatgagcgaggtgctcaaggctatatgggaggacaaagtccatgtcctgggtgcgtttgcttggagctttgcggacaactgggaattcggtgattacgacgcgcactttggcattcagacggtcaatcgcaccacgcaggagaggcggtacaagaagagtttcttcgacttggttgattttgttgccgcgaggtcgaactag

SEQ ID NO: 105 - protein, 620 aa, M. phaseolina
MFSLLVLSCGAVALAQQVYISADGPIPRPQCSASQTYSATYATPTYAFSNFSFTQTETVRTATSIKSAPITTYAPPYESLSHLVPNLSTTTWGNWYPNATTTAADTTDPYGQAAWSALWEHASLANFTFRGLYSTTVSPTPVPTSELVLPPPEYFVPQDCYSFPDTFMFGVAGSASQIEGAIADEGRTPSLMEVLIPPSSGKPTNYVTNENYYLYKQDIERLAAMGVKYYSLSIPWTRILPFVVEGSPVNKQGLDHYDDLINFVLSRGMVPTVTLLHFDTPLQFYGDNITSAADPPLIGYTNGAYQNETFEDAFVNYGKIVMTHFADRVPVWFTFNEPLLYSYNGKSVDTVIKAHARLYHFYHEEINGTGQVGIKFNDNFGVPLDPTNSSDVEAANHFNDFQLATFANPIFLGKDYPEAFKITIPDYVPLTDEDLEYIGGTSDFLGIDPYTATVVTPAPNGIAVCASNTSDPLFPYCVEQSTLTSAGWNIGYRSQSYVYITPKYLRTYLSYLWNTFRHPVLITEFGFPVFGEADKEDLSDQLYDFPRSNYYLSFMSEVLKAIWEDKVHVLGAFAWSFADNWEFGDYDAHFGIQTVNRTTQERRYKKSFFDLVDFVAARSN

SEQ ID NO: 106 - DNA, 2208 bp, M. phaseolina
tgcgacttgaggttgcgacggagatgcgtgggccctttcatttaacatgtcttggaacttttcacgcactctgcctgttttgtcaccgcggaccgggttttgcctatgcatgtgcgcagatcttgtgtcccacgtttgacccgtctgtcgatgtctacgaacctttgtctttacccatctctatgtcgtggtacagcggtgcccatacacttctctgccatcacaatgcaaagctccgccgccggatagtgccgccaaagcctcatcagcacgtccggatctctgggacggtggaaagcagggtactgtatacaatcactgacttgcgccagattattggaatatcttcgtcggccccgtttccaccgcgtctatcaacaccacggtcgagccgacgccgatcccttccagctccctcattccaccgccagggctctactatccggcctatcctaccggtcaacagacccccctacaggctaaaaatgagagctggtcatttccttctgacttctggtggggcgtctcaagcgcttcttaccaagtagaaggcgctgcaaaagacgaaggcaaaggcccaacaatatgggacgtgtttgcgcacagagtgaatggctacatcacgaccaacgagactggcgacatctccgacaatgagtactatctttacaaagagggtgcgtcaagtttgagacctgagactagcattgagacgtccttctgcaggccccttactgacgcagttggcaatcggcagatatcgcgcgcatcgcggccatgggtgtgaaagtgtactctttctccatctcctgggcgcgcatcttccccttcggtgctggcgcagtgaatgagcaagggctcgcgcattacgacgacttgatcgatacatgcattcagtatggcatcaaacctgctgtcacgctctaccactgggatctgccgctcttcctgcagaacaagtacggcggttggctatcttccgacatcgtacctgacttcgtcgcttacgctcgtgtgctgtttgagcgctggggtaataaggtgccgtattggtacacattcaacgaacccatcgttttctgcgggttctatccccttccatatcattactttgccgcaacctccataccagacgtccagcagccctactactgcggtcaccacgtcctccaagcccacgcgcaagcttaccgcctcgccaaatccctcaacctcaccggcactgtctccctgaagctcaacggcggctacaagatccccctcaccaacagcaccgccgacgccgaggcgacccaacgtgcctgggacttcaacgaaggctggttcgcgaacccgctcttcatcgacggcgactacccatcccgcctcaaagactacgtttccggattcctccccgccttcactgatgccgaaaaaaccgccctcaacggctccgccgacctcttcgcccatgatgcctacacaagcaacttcgtcgccgtcccggatgacggcatcacgtcctgcatcgccaatgcctccaatcccctctacccaggctgctacaacaccacctacacctactcgcgcgcctccggcggctggaacatcggccccgccgccgaccccaaagcgccctggctgcacaaggcgaccgattgggttcccacgttcctgcgctacatccaggacacctggcgcccggcaggcggcatcgctgtcagcgagttcgggttcggcgagccgttcgagcggcagaagacgatcctcgccgatatcctgttcgatccaatcaggagcgcgtatttccatgactatatggaggccattttgattgcgttggcggaagggacgcgggtggtgggatgtctggcgtggagtttgattgataatttggagtggacgacggggtatgatgtcaaatttgggttgcaggtgagtttgaggcactttctttgagcgaggctgtaagctaatggcagggggatgcagtatgtcaacttcacaacgcaggaacggttttataaggcgagtttcttcgagtatgtcaatgcgttcaaggtgtatcaggagcagtgaatagttttcagttgccttgtccactgcaacgtgatagagcttcaatcaaatgtaattaccgactttcccatcaccttgcccgtttttaatattctcttcctacgccgcggagcaggaagaggagaatatagtgtccgcttaacaaagatt

SEQ ID NO: 107 - DNA, 1629 bp, M. phaseolina
atgtctacgaacctttgtctttacccatctctatgtcgtgattattggaatatcttcgtcggccccgtttccaccgcgtctatcaacaccacggtcgagccgacgccgatcccttccagctccctcattccaccgccagggctctactatccggcctatcctaccggtcaacagacccccctacaggctaaaaatgagagctggtcatttccttctgacttctggtggggcgtctcaagcgcttcttaccaagtagaaggcgctgcaaaagacgaaggcaaaggcccaacaatatgggacgtgtttgcgcacagagtgaatggctacatcacgaccaacgagactggcgacatctccgacaatgagtactatctttacaaagaggatatcgcgcgcatcgcggccatgggtgtgaaagtgtactctttctccatctcctgggcgcgcatcttccccttcggtgctggcgcagtgaatgagcaagggctcgcgcattacgacgacttgatcgatacatgcattcagtatggcatcaaacctgctgtcacgctctaccactgggatctgccgctcttcctgcagaacaagtacggcggttggctatcttccgacatcgtacctgacttcgtcgcttacgctcgtgtgctgtttgagcgctggggtaataaggtgccgtattggtacacattcaacgaacccatcgttttctgcgggttctatccccttccatatcattactttgccgcaacctccataccagacgtccagcagccctactactgcggtcaccacgtcctccaagcccacgcgcaagcttaccgcctcgccaaatccctcaacctcaccggcactgtctccctgaagctcaacggcggctacaagatccccctcaccaacagcaccgccgacgccgaggcgacccaacgtgcctgggacttcaacgaaggctggttcgcgaacccgctcttcatcgacggcgactacccatcccgcctcaaagactacgtttccggattcctccccgccttcactgatgccgaaaaaaccgccctcaacggctccgccgacctcttcgcccatgatgcctacacaagcaacttcgtcgccgtcccggatgacggcatcacgtcctgcatcgccaatgcctccaatcccctctacccaggctgctacaacaccacctacacctactcgcgcgcctccggcggctggaacatcggccccgccgccgaccccaaagcgccctggctgcacaaggcgaccgattgggttcccacgttcctgcgctacatccaggacacctggcgcccggcaggcggcatcgctgtcagcgagttcgggttcggcgagccgttcgagcggcagaagacgatcctcgccgatatcctgttcgatccaatcaggagcgcgtatttccatgactatatggaggccattttgattgcgttggcggaagggacgcgggtggtgggatgtctggcgtggagtttgattgataatttggagtggacgacggggtatgatgtcaaatttgggttgcagtatgtcaacttcacaacgcaggaacggttttataaggcgagtttcttcgagtatgtcaatgcgttcaaggtgtatcaggagcagtga

SEQ ID NO: 108 - protein, 542 aa, M. phaseolina
MSTNLCLYPSLCRDYWNIFVGPVSTASINTTVEPTPIPSSSLIPPPGLYYPAYPTGQQTPLQAKNESWSFPSDFWWGVSSASYQVEGAAKDEGKGPTIWDVFAHRVNGYITTNETGDISDNEYYLYKEDIARIAAMGVKVYSFSISWARIFPFGAGAVNEQGLAHYDDLIDTCIQYGIKPAVTLYHWDLPLFLQNKYGGWLSSDIVPDFVAYARVLFERWGNKVPYWYTFNEPIVFCGFYPLPYHYFAATSIPDVQQPYYCGHHVLQAHAQAYRLAKSLNLTGTVSLKLNGGYKIPLTNSTADAEATQRAWDFNEGWFANPLFIDGDYPSRLKDYVSGFLPAFTDAEKTALNGSADLFAHDAYTSNFVAVPDDGITSCIANASNPLYPGCYNTTYTYSRASGGWNIGPAADPKAPWLHKATDWVPTFLRYIQDTWRPAGGIAVSEFGFGEPFERQKTILADILFDPIRSAYFHDYMEAILIALAEGTRVVGCLAWSLIDNLEWTTGYDVKFGLQYVNFTTQERFYKASFFEYVNAFKVYQEQ

SEQ ID NO: 109 - DNA, 954 bp, M. phaseolina
agatcgccttccgcgcccgacgtgttgtccgagctgttgacagccagtggcatccccgctggagctctaattggtggagctagcacgaatggctacactgcagccgagagctactatctctacaggcaagatatcgaccgtctcgcggccatggggatcaagttctactcctttagcatctcgtggacacggattctccctttcgccctccccggctctcctgtcaactcaaatggccttgaacattacgacaacctcaccaattacgctatcaccaaaggggtccagcccgtcgtggcacttctgcatatggacacgcctctgcagttctttggagactactacgttgaaggaatcaggcagagaccctactacggctacttcaacatgggataccaaaacgagaccttcgaagaggctttcgtaaattacggcaaaatcattatgtctcgcatcgccgacagagtgccgatctgggtgacggtcaacaagccacagacgggctgtgtgagcggcccttcaatagaccacatcattaaagcgcatgcccgcctctataatttttaccatgatgagctgcatggtacgggtaagatcaccatgaagatggcttggacgccgggagtgccggaggatcctaagaacgagacgcatctcgtggccgtccagcactacaacgacctcctggccgaaaccttgaaactgctcgtgctaggccaagactatcacgacgccttcaagaacgcgatacaagactacgtcgccctgagcgcaggagacctcgcacccctccgaacagcatgattttgctgacaaacgcaaacagacatcctctccttcgacggctacagtgccgtatcagtcttccccgccgtccctgatctcgatatctgcgccaccgacaacgcgacttccagccgctactatcccacctgtgccggcacaacccagcgg

SEQ ID NO: 110 - DNA, 654 bp, M. phaseolina
atggggatcaagttctactcctttagcatctcgtggacacggattctccctttcgccctccccggctctcctgtcaactcaaatggccttgaacattacgacaacctcaccaattacgctatcaccaaaggggtccagcccgtcgtggcacttctgcatatggacacgcctctgcagttctttggagactactacgttgaaggaatcaggcagagaccctactacggctacttcaacatgggataccaaaacgagaccttcgaagaggctttcgtaaattacggcaaaatcattatgtctcgcatcgccgacagagtgccgatctgggtgacggtcaacaagccacagacgggctgtgtgagcggcccttcaatagaccacatcattaaagcgcatgcccgcctctataatttttaccatgatgagctgcatggtacgggtaagatcaccatgaagatggcttggacgccgggagtgccggaggatcctaagaacgagacgcatctcgtggccgtccagcactacaacgacctcctggccgaaaccttgaaactgctcgtgctaggccaagactatcacgacgccttcaagaacgcgatacaagactacgtcgccctgagcgcaggagacctcgcacccctccgaacagcatga

SEQ ID NO: 111 - protein, 217 aa, M. phaseolina
MGIKFYSFSISWTRILPFALPGSPVNSNGLEHYDNLTNYAITKGVQPVVALLHMDTPLQFFGDYYVEGIRQRPYYGYFNMGYQNETFEEAFVNYGKIIMSRIADRVPIWVTVNKPQTGCVSGPSIDHIIKAHARLYNFYHDELHGTGKITMKMAWTPGVPEDPKNETHLVAVQHYNDLLAETLKLLVLGQDYHDAFKNAIQDYVALSAGDLAPLRTA

SEQ ID NO: 112 - DNA, 3139 bp, M. phaseolina
tgccggcgccgctgtcgccttcttatgctgtgaggcattacgagtcggctgtgcggctcgtgcggatgtaggacgggtcgtgatagatataaagtccctagaatgggccgtcgctttgaggctcatcgagcttgtcaatctcccttcgccatggcttccgcaatcaactttctggctctgctcgggattgttacttccttggtggccccggcatccgcctgggaccattccctgtacaccaccagcccggctgttctgccttcacgtaagtgccgtttattgctctctgattttttcacccagtttgtagacttgggttgggttggctgtgtttttattcatttttcacactaccactgaatatgagcgctgagaggataatttctaacacccaccagcaaacaccactggcgcgggatgggaagacgcgttcgccaaggccaaggacttcttggccgagctgaccttggaggagaaggttgcaatggtcactggaacatctggtccctgccctgtaagtcttatgcctagaccttaagacaacatcgagtctacatgtccgccagagttctaccatggcagtggccacgacgtcggcgtcaaaattattgcaacatgcccgttgcagagagttgaattatgtacctgggcacatatgatcaatcttttggccacttacatccacatgtactcttcaactctcctcggaaatggcaggttgcaataattcagcccccgacgtcatcaccgccaaaacaccacgcaaaaaaaaaacccccctttttcgcttgagcattatgctaatttggtctagggtatgatcgctcccgttgagcggctcaacttcactgggttgtgccttcaagacggcccgctggctatcagacaggctgtgtatgcgaacgtcttccctgctggtgtaaatattgcttcaacatgggaccgcaacgccttctaccagcgcagcaagtacatgggagctgagttcaaggctaagggtgctcaaattgctcttactccggtcgtggggcctcttggtagggacccatatggtggccgtaactgggagggcttctctcctgacccctacctgagcggcgtgggtgtcgaagaatctgtctggggcatccagggagccggtgtgcaggcaacgacgaagcacttcattggcaatgaacaagaaacgcagcgcaaccccagcaccgctgctgacggcacgaccattatgtccctgtcgtccaacatcgacgacaagacgatgcatgaaagctacctgtggcctttcgccaacgcagtccacgctggtactgctagcattatgtgctcctacaaccgtatcaacggctcctatggttgccagaactctaaggcactgaacggccttctcaagactgaactcaacttccagggctacgtcatgtccgactggggtgcagttcactctggcgtcgcgaccatcgagtcgggactcgatgttaatatgccgggcggtattagcttcagttcgcccagtccatcatactggggagaaaatgcaactcttgcggtgaccaatggcaccatccctgagagcaggatcgatgacatggtcctcagagttctgaccccctacttccatcttggccaggacaaagacttccctaaggttgacgcttattcttccattctcaacggcaaggcggaatccacttggctgtacgacttcaaggtcggtaccgaggctgaagtcgtggatctccgcaacgaagagacaaccaagttcatccgcgactctgccgcgaacggcactatccttctcaagaacacaaatggcgctctgcctctgaaggctcccaagaacgttgctgtctttggaaatgctgctactgagtacaccgacggtctctactccctcgtcggcggtagcccctttaagtctcacgacgctgagcagggtacacttggtgccggtggcggtagcggtacgggtcgcttcgctcaaattgtgactcctcttgaagcactcaaggcgaaggccaaggaggacggctctctacttcaatacatgctcgagaacgaagccatcatccagtatggtaccgacgccatattccctctccctgacgtctgccttgtcttcattaagtcttgggctaccgagggctacgaccgcgagaccatctaccccgagtacaacggtacgggcgtcgtcaacactgtcgccgccagctgcaacaacaccgtcgtcgtccactacggcactggcccgaccctcttccccttcgctaccaaccccaatgtcaccgccatcatcgccgcgcacttccccggccaggagtctggcaacacgctcgtcgacatcctctacggcgccaccaacccgtccggccacctcccctacaccatccccgtctcggacaccgtcttccccaagaccctcgtcaacagcaccgccctggtcgaaacaaccgacccggatgcgtggcaggccgacttcaccgagggcaacatgatcgactaccgctactacatcgccaccaacaagacctcctccgtcctctaccccttcggcttcggcctgtcctacaccaccttcgccgcctccgacctcgtcgtcgagaaggccaccgacgcctctctcgccggcaccaccccggccgccgacgccaaggtcgtgcccggcggcaacagcgagctgtgggagaccgtgtacaccgccaacgtcaccgtcgccaacacgggcgacgtcgccggcgccgccgtcccccagctgtacctcaacctgctggacgccggcgcgcccgccggcacccctgcctggcaactgcgcggcttcgaccgcgtgtggctcgcgccaggcgagagcaagaccgtcggcttcgagctgctgaggcgcgacgtctcgtactgggacgtcgtggcgcaggactggagggttcccgagggcgagatcaaggtcgaggtcggcttcaacgtcgcggagaggacgctgagtgcgacgttggcgtaaagcaggatagatgacgatttaatgatagggtacgataatagcattagttcttatgacatcaggtaatagcaatcgaatgataatctcgaaataaccttctgccagcacctggactgtattgtgtatgtgtattgaggcgacgtctattct

SEQ ID NO: 113 - DNA, 2406 bp, M. phaseolina
atggcttccgcaatcaactttctggctctgctcgggattgttacttccttggtggccccggcatccgcctgggaccattccctgtacaccaccagcccggctgttctgccttcaccaaacaccactggcgcgggatgggaagacgcgttcgccaaggccaaggacttcttggccgagctgaccttggaggagaaggttgcaatggtcactggaacatctggtccctgccctggtatgatcgctcccgttgagcggctcaacttcactgggttgtgccttcaagacggcccgctggctatcagacaggctgtgtatgcgaacgtcttccctgctggtgtaaatattgcttcaacatgggaccgcaacgccttctaccagcgcagcaagtacatgggagctgagttcaaggctaagggtgctcaaattgctcttactccggtcgtggggcctcttggtagggacccatatggtggccgtaactgggagggcttctctcctgacccctacctgagcggcgtgggtgtcgaagaatctgtctggggcatccagggagccggtgtgcaggcaacgacgaagcacttcattggcaatgaacaagaaacgcagcgcaaccccagcaccgctgctgacggcacgaccattatgtccctgtcgtccaacatcgacgacaagacgatgcatgaaagctacctgtggcctttcgccaacgcagtccacgctggtactgctagcattatgtgctcctacaaccgtatcaacggctcctatggttgccagaactctaaggcactgaacggccttctcaagactgaactcaacttccagggctacgtcatgtccgactggggtgcagttcactctggcgtcgcgaccatcgagtcgggactcgatgttaatatgccgggcggtattagcttcagttcgcccagtccatcatactggggagaaaatgcaactcttgcggtgaccaatggcaccatccctgagagcaggatcgatgacatggtcctcagagttctgaccccctacttccatcttggccaggacaaagacttccctaaggttgacgcttattcttccattctcaacggcaaggcggaatccacttggctgtacgacttcaaggtcggtaccgaggctgaagtcgtggatctccgcaacgaagagacaaccaagttcatccgcgactctgccgcgaacggcactatccttctcaagaacacaaatggcgctctgcctctgaaggctcccaagaacgttgctgtctttggaaatgctgctactgagtacaccgacggtctctactccctcgtcggcggtagcccctttaagtctcacgacgctgagcagggtacacttggtgccggtggcggtagcggtacgggtcgcttcgctcaaattgtgactcctcttgaagcactcaaggcgaaggccaaggaggacggctctctacttcaatacatgctcgagaacgaagccatcatccagtatggtaccgacgccatattccctctccctgacgtctgccttgtcttcattaagtcttgggctaccgagggctacgaccgcgagaccatctaccccgagtacaacggtacgggcgtcgtcaacactgtcgccgccagctgcaacaacaccgtcgtcgtccactacggcactggcccgaccctcttccccttcgctaccaaccccaatgtcaccgccatcatcgccgcgcacttccccggccaggagtctggcaacacgctcgtcgacatcctctacggcgccaccaacccgtccggccacctcccctacaccatccccgtctcggacaccgtcttccccaagaccctcgtcaacagcaccgccctggtcgaaacaaccgacccggatgcgtggcaggccgacttcaccgagggcaacatgatcgactaccgctactacatcgccaccaacaagacctcctccgtcctctaccccttcggcttcggcctgtcctacaccaccttcgccgcctccgacctcgtcgtcgagaaggccaccgacgcctctctcgccggcaccaccccggccgccgacgccaaggtcgtgcccggcggcaacagcgagctgtgggagaccgtgtacaccgccaacgtcaccgtcgccaacacgggcgacgtcgccggcgccgccgtcccccagctgtacctcaacctgctggacgccggcgcgcccgccggcacccctgcctggcaactgcgcggcttcgaccgcgtgtggctcgcgccaggcgagagcaagaccgtcggcttcgagctgctgaggcgcgacgtctcgtactgggacgtcgtggcgcaggactggagggttcccgagggcgagatcaaggtcgaggtcggcttcaacgtcgcggagaggacgctgagtgcgacgttggcgtaa

SEQ ID NO: 114 - protein, 801 aa, M. phaseolina
MASAINFLALLGIVTSLVAPASAWDHSLYTTSPAVLPSPNTTGAGWEDAFAKAKDFLAELTLEEKVAMVTGTSGPCPGMIAPVERLNFTGLCLQDGPLAIRQAVYANVFPAGVNIASTWDRNAFYQRSKYMGAEFKAKGAQIALTPVVGPLGRDPYGGRNWEGFSPDPYLSGVGVEESVWGIQGAGVQATTKHFIGNEQETQRNPSTAADGTTIMSLSSNIDDKTMHESYLWPFANAVHAGTASIMCSYNRINGSYGCQNSKALNGLLKTELNFQGYVMSDWGAVHSGVATIESGLDVNMPGGISFSSPSPSYWGENATLAVTNGTIPESRIDDMVLRVLTPYFHLGQDKDFPKVDAYSSILNGKAESTWLYDFKVGTEAEVVDLRNEETTKFIRDSAANGTILLKNTNGALPLKAPKNVAVFGNAATEYTDGLYSLVGGSPFKSHDAEQGTLGAGGGSGTGRFAQIVTPLEALKAKAKEDGSLLQYMLENEAIIQYGTDAIFPLPDVCLVFIKSWATEGYDRETIYPEYNGTGVVNTVAASCNNTVVVHYGTGPTLFPFATNPNVTAIIAAHFPGQESGNTLVDILYGATNPSGHLPYTIPVSDTVFPKTLVNSTALVETTDPDAWQADFTEGNMIDYRYYIATNKTSSVLYPFGFGLSYTTFAASDLVVEKATDASLAGTTPAADAKVVPGGNSELWETVYTANVTVANTGDVAGAAVPQLYLNLLDAGAPAGTPAWQLRGFDRVWLAPGESKTVGFELLRRDVSYWDVVAQDWRVPEGEIKVEVGFNVAERTLSATLA

SEQ ID NO: 115 - DNA, 2981 bp, M. phaseolina
ctgcccatctggcaaccgggaaacaaacttcgactcgggttggagccgcagtgattctcgcataaagagtctccgtcccgccgctatcatggcgcttcactctacgttgattccgctcatttgcgcttccccttcctttaagaagccaaaatgagaggcccgatcgccttcgccgtggccgcggccgcggtcagcaatgctcaaagtaagtagccccagccccaaggcaaagaaagttgaacggatcaacaaaaggggatacgatcaaagagcagggaattctcatctgccacgatactgacttcccgcaaccccagcttcccacacgcccaccgtcgactggaccgcggcctacgacaaagccacttcggccctcgcccagatcaaccaaactgaaaaagttggaattgtcactggtgtcggctggggtaatggtccctgcgtcggcaacacttacccagtccccaaaatcggctatccgtcactgtgccttcaggatggtcccttgggcgtgcggtatgcgtccaacgtgagcgcctttccggcgggtattcaagccgctgcaacttgggatcgggagttgatctaccagcgcggtctcgcgctgggtaaggaggccaaggggttgggtgtgaatgtgcagttgggcccggtttcgggagctcttggaaaggtggggttttgaattatattccttgcactaactgctttctacaatatccccttgtgagccagacgcagcagacttcctcagagcttttttgcttcctatttcttaaagagatactgacagccacacgcagatccctgaggccggaaggaactgggagggattctccccggatccgtacctggccggaatctgcatgttcgagacgattgtcggcatgcaagagggcggtgttcaggcttgcgctaagcattatctcctcaatgaacaggagttgaatcgaactacgatttccgccaacgccgacgatcggacgacgcacgagttgtacctctggccattcgccgatgcggtcaaggctggagtcacgtctttcatgtgctcctacgtaagtgcagcatacttcgccagtccggaaaaactggcggactaaaaagagtaatagaacaaactcaacggcacgtgggcttgcgagaacgacaagatcctgaacggcctcttgaaggacgagctcgactacaagggctttgtcatgaccgactggggcgcgcaccacaccaccgtcgacagcgccatcgcaggcctcgacatgtcgatgccgggaactgactacggcaagtcgcccgaaagcctctactggggcgccaacctcaccgcagctgttgaggccggcgacatcccgcaggagcgcctcgacgacatggtcctccgcatcctcgccgcctggtacgcccttggccaggacgatccggccttccctgcagtgcagttcgactcgtgggtcgacggtgagaagggcggctacgaggcgccgcagacgcagcacaacgagctcgcccgcgccgtcgcccgcgacggtatcgtcctgcttaagaatgagaatgccactctccccatcaagccgacctccggcagcctcgcaatcatcggtgacgacgcgcgcgtcaatcccgccggccccaacgcctgctctgaccgcgcctgcaccaacggcacgctcgccgtcggctggggatctggcgcgaatgagtttcccgtaagcacacatgcaaataccacgtcatccgtctacaagaaacagcctttttattaacgaacatgaaccgcacatagtacctcatcgcgccgctcgacgccatccgagagcgcgcctccgccgccggcaccaccatcatcgcctctcccaccgacgaccaggcggcgggcgccagcgctgccgccgccgcagagacggccatcgtcttcatcgtgtccaacagtggtgaggagtatctgaccgtcgagaacaacgtcggagaccgcatcaacctcgacccttggcacgatggcaatgggctagtagccgcggttgccgaggccgctgcgggcaagcccgtcgtcgtcgtcgcgcatagcgtcggcccgatcattttggagtctatcctcagccacgagaatgtcgtcgcgctggtgtgggcgggattgggcgggcaggagcagggcaacgcgttggcggatgtgctgttcggagacgttagtccgagcggcaagctgccctacacgattgcgaaggcggcggaggactacgggacgaagctggtggggccggatgtggatgatgagtttgaggaggggctgtacatcgactacaggcatttcgacaaggcggggatcgagccgcggtacgagttcgggtttggcctgtgtaagtgctcctttccttgccttcaccgcatttgttttgtgtgcggactgaggcgcaggattgaactgactttttggtttgatgcgcgcagcctacaccaacttcacctactcggacatcgcaattaccaagacggcagccagcaatgccaccgctggatctacggacctctacgccccgttcgccaccgtcacggccaccatcgccaactccggcgacgtcgccggtgcggaggtcgctcagctgtacctctcgctgcccgctggcattgacgccccgccgaagcagctgcgcggcttcgagaagatcagtctcgaggccggtgccagcgcatctgtcgagttcgtgcttaggcgcaaggatgccagctactggaatgtcgagcggcagcaatggatcttgccgacgggcgattttggcatcgcggtagcggcgagctcaagggatttgagactggaggggacgctgacggtttagaggtgagaaggaggcgtagagtcttgtagatgattgagagtgtctttattgacacaggcagcggagcagtctcccggacggatatgttcgaggtaacttatcccaatggaatctgcggcattgttgtcctctactttcacgccgtggcag

SEQ ID NO: 116 - DNA, 2214 bp, M. phaseolina
atgagaggcccgatcgccttcgccgtggccgcggccgcggtcagcaatgctcaaacttcccacacgcccaccgtcgactggaccgcggcctacgacaaagccacttcggccctcgcccagatcaaccaaactgaaaaagttggaattgtcactggtgtcggctggggtaatggtccctgcgtcggcaacacttacccagtccccaaaatcggctatccgtcactgtgccttcaggatggtcccttgggcgtgcggtatgcgtccaacgtgagcgcctttccggcgggtattcaagccgctgcaacttgggatcgggagttgatctaccagcgcggtctcgcgctgggtaaggaggccaaggggttgggtgtgaatgtgcagttgggcccggtttcgggagctcttggaaagatccctgaggccggaaggaactgggagggattctccccggatccgtacctggccggaatctgcatgttcgagacgattgtcggcatgcaagagggcggtgttcaggcttgcgctaagcattatctcctcaatgaacaggagttgaatcgaactacgatttccgccaacgccgacgatcggacgacgcacgagttgtacctctggccattcgccgatgcggtcaaggctggagtcacgtctttcatgtgctcctacaacaaactcaacggcacgtgggcttgcgagaacgacaagatcctgaacggcctcttgaaggacgagctcgactacaagggctttgtcatgaccgactggggcgcgcaccacaccaccgtcgacagcgccatcgcaggcctcgacatgtcgatgccgggaactgactacggcaagtcgcccgaaagcctctactggggcgccaacctcaccgcagctgttgaggccggcgacatcccgcaggagcgcctcgacgacatggtcctccgcatcctcgccgcctggtacgcccttggccaggacgatccggccttccctgcagtgcagttcgactcgtgggtcgacggtgagaagggcggctacgaggcgccgcagacgcagcacaacgagctcgcccgcgccgtcgcccgcgacggtatcgtcctgcttaagaatgagaatgccactctccccatcaagccgacctccggcagcctcgcaatcatcggtgacgacgcgcgcgtcaatcccgccggccccaacgcctgctctgaccgcgcctgcaccaacggcacgctcgccgtcggctggggatctggcgcgaatgagtttccctacctcatcgcgccgctcgacgccatccgagagcgcgcctccgccgccggcaccaccatcatcgcctctcccaccgacgaccaggcggcgggcgccagcgctgccgccgccgcagagacggccatcgtcttcatcgtgtccaacagtggtgaggagtatctgaccgtcgagaacaacgtcggagaccgcatcaacctcgacccttggcacgatggcaatgggctagtagccgcggttgccgaggccgctgcgggcaagcccgtcgtcgtcgtcgcgcatagcgtcggcccgatcattttggagtctatcctcagccacgagaatgtcgtcgcgctggtgtgggcgggattgggcgggcaggagcagggcaacgcgttggcggatgtgctgttcggagacgttagtccgagcggcaagctgccctacacgattgcgaaggcggcggaggactacgggacgaagctggtggggccggatgtggatgatgagtttgaggaggggctgtacatcgactacaggcatttcgacaaggcggggatcgagccgcggtacgagttcgggtttggcctgtcctacaccaacttcacctactcggacatcgcaattaccaagacggcagccagcaatgccaccgctggatctacggacctctacgccccgttcgccaccgtcacggccaccatcgccaactccggcgacgtcgccggtgcggaggtcgctcagctgtacctctcgctgcccgctggcattgacgccccgccgaagcagctgcgcggcttcgagaagatcagtctcgaggccggtgccagcgcatctgtcgagttcgtgcttaggcgcaaggatgccagctactggaatgtcgagcggcagcaatggatcttgccgacgggcgattttggcatcgcggtagcggcgagctcaagggatttgagactggaggggacgctgacggtttag

SEQ ID NO: 117 - protein, 737 aa, M. phaseolina
MRGPIAFAVAAAAVSNAQTSHTPTVDWTAAYDKATSALAQINQTEKVGIVTGVGWGNGPCVGNTYPVPKIGYPSLCLQDGPLGVRYASNVSAFPAGIQAAATWDRELIYQRGLALGKEAKGLGVNVQLGPVSGALGKIPEAGRNWEGFSPDPYLAGICMFETIVGMQEGGVQACAKHYLLNEQELNRTTISANADDRTTHELYLWPFADAVKAGVTSFMCSYNKLNGTWACENDKILNGLLKDELDYKGFVMTDWGAHHTTVDSAIAGLDMSMPGTDYGKSPESLYWGANLTAAVEAGDIPQERLDDMVLRILAAWYALGQDDPAFPAVQFDSWVDGEKGGYEAPQTQHNELARAVARDGIVLLKNENATLPIKPTSGSLAIIGDDARVNPAGPNACSDRACTNGTLAVGWGSGANEFPYLIAPLDAIRERASAAGTTIIASPTDDQAAGASAAAAAETAIVFIVSNSGEEYLTVENNVGDRINLDPWHDGNGLVAAVAEAAAGKPVVVVAHSVGPIILESILSHENVVALVWAGLGGQEQGNALADVLFGDVSPSGKLPYTIAKAAEDYGTKLVGPDVDDEFEEGLYIDYRHFDKAGIEPRYEFGFGLSYTNFTYSDIAITKTAASNATAGSTDLYAPFATVTATIANSGDVAGAEVAQLYLSLPAGIDAPPKQLRGFEKISLEAGASASVEFVLRRKDASYWNVERQQWILPTGDFGIAVAASSRDLRLEGTLTV

SEQ ID NO: 118 - DNA, 3381 bp, M. phaseolina
ccgcgcctccctagaccgggaaagcatgcaagtcatgaccggaccttgcactgtatataagagaaatgtcaagaccgtttcgtttcctttgccatcgacaacggcgtcccttggccctcctccgaactccgactgcttgttttgacagccatgctgcttgaccggctgcctctggtggccgcttttggctccgtatgctcggcaggggccatctcggtccggcagagctcgtccggtgtcgacagctgcccgggatacacggcttcgaatgttgttgactcgggtactacgcttactgccgatctaagcctggcgggcgcctcatgcaatgcttacggcgacgatctcacagatctgaagctcaacgtcgagtaccagaccggtgagtagcaatacctttttccttgcttgtcgcatcgacttggaaacagcgggcggccagggcagcatcaggcctcaaagcttctccgattggtgactggaccggctggggcaaatataccgctacacgtcacacggaagcgtgatggcaagctcgcttctgcattacagctgtttcaaacccatgcttcacaccggtcgtctgcaagttttcgttgctgtctcccgagttcctctctctctccattgcattagccggcataaattcttggcgccattcgaaacggttgctgacgcgggagaaaactgcacagccaatcgcctccatgtccaaatctatgacgcggcagaaaatgtctaccaggtgccggaatccgtcctcccacgtccgaatgctggaaatggctccgctgcggcgtctgccatccagttcaagtgggttgagaatccattttcgttttctgtcgtccgcacggcaaccaatgagacgctcttcgacactgctgactcgccgctcgtgttcgagacgcagtattggagactgaggaccaagttacccagtgaaccgaatctctacggcttgggcgagcacagtgattcgtttcgtctgaataccaccaactacacccgtacgatctggaacagagatgcctatggtgttcctcctggatcaaatttgtacggcgcccaccctgtctactttgaccacaggggtccttcaggcactcacggtgtctttttgctgaattccaacgggattgaagcgaaaatcaacaacaccgatggtcagtacctggagtacaatgtccttggcggcattgtcgacctctatttcctcgcgggcccgactccgaaggatgtcagcaagcaatatgccgaagtagtgggacttcccgcaatgcaagcatactgggcctttggcttccaccagtgcagatatgggtaccgcgacgtctatgatgtcgcggaagtcgtcgccaactattcgctggccggcattcctctcgagaccatgtggacagacattgactacatggacctcaggaaagtctttacgctggacccggcgcgctttccgcttgagttggtgcgcgagttggtgaattatctgcacgcacatcaacagcactacatcgtcatggttgacccagcagtcgcctatcggaacaacacggcatacgatatcggggaccagcaggacgtattcctcaaagtttcgaacggctcctatttcattggagtggtctggcctggtccgacggtatttcctgactggttccaccccaacacccagccttactgggacgatcaattcgcaagcttcttcagcgccgacacaggagtagacatcgacgcgttgtggatcgacatgaacgaagcggccaacttttgcgtctttccctgttctgatcctttcggctacgcggaagcaaacaatcagccgccggacccgccgccagtgcgcgccaatagcggacgacccattcccggcttccctgccaactttcaacccggcggagttactccacctagcagggtcaggaccagacggcagacggctggtaccaaggccggcctgccgggacgagaccttctaaacccagaatataccattgcgaacttggctggcgtgatttccgcaaacaccatcaacacggatgtgatccaccataatggcttggccgagtacgacacgcacaacctgtacggcaccatgatgtcgacggcgagcagaatcgccatggagaagcgccgacctggcaggagaccgctggtaatcacccgcagcacctttgcaggcgctgggagggacgtagggcactggctaggggataatctttcggattgggagcattacaggtgagaatgaagccaagcgcgagcgcgaaatgatgtggctgacgaacgaacagattctcgatttcccaacttcttcagtttgccgctctgtaccaggtgcctatggttggctctgatgtctgtgggttcgggtccaacacaacggagactttgtgcgcgagatgggcgctgctgggagcattttctacgttctacagggtaagtcgggatgaagcactgaggcctgacattggctgacagtcctttcagaatcacaatcaggacaacgcaatttcgcaggaattctacaggtggccgctggtgacggaggcggccaagaatgcaatcagcatacggtaccagctgcttgactacatctacaccgccttccaacggcagactcaaacgggtgagccagtggtcaacccgctattcttcaactatccaaccgacgcaaacacgttcggcatcgatttgcagtacttttacggagactcgattctcgtgagcccggtgacggaagagaacgtaactacggtcgacatctacctgccagatgacatcttttacgacttccacaccggcgagacggtgcgagggaacggctcgttcatcacgctccctgacgtcccatacacgaccattcccctgcacgtgaggggaggcagcatcatcccgctgcgagcggcatcagccaacacgacgacggagctgcgaaagcagaatttcacgctgctcattgctcccggtttggacggcacagccagtggcagcctgtacctggatgagggcgatgcgatcgcgcagccggccacgtcggagattcaattcaactacgacgggcagaagctggtgctgagcggatcgtttggatacaattcgggggtggtgataagcggggtgcgggtgctgggatcgtctggcaacggcacaacatcagcgggcaggatcatggcagctaaggcgccactgtcgattgcgctcgactcggcggcagagatagcattgtagagcggtagccgaaagcagggaagagcgagccactatgaccacttggctcgcatcggctgatgactggactgtagcttttttctattagtgcgctgagatgcccgtgactcggtgcaggatggcggccgtgacagccgacgtggctgatgc

SEQ ID NO: 119 - DNA, 2664 bp, M. phaseolina
atgctgcttgaccggctgcctctggtggccgcttttggctccgtatgctcggcaggggccatctcggtccggcagagctcgtccggtgtcgacagctgcccgggatacacggcttcgaatgttgttgactcgggtactacgcttactgccgatctaagcctggcgggcgcctcatgcaatgcttacggcgacgatctcacagatctgaagctcaacgtcgagtaccagaccgccaatcgcctccatgtccaaatctatgacgcggcagaaaatgtctaccaggtgccggaatccgtcctcccacgtccgaatgctggaaatggctccgctgcggcgtctgccatccagttcaagtgggttgagaatccattttcgttttctgtcgtccgcacggcaaccaatgagacgctcttcgacactgctgactcgccgctcgtgttcgagacgcagtattggagactgaggaccaagttacccagtgaaccgaatctctacggcttgggcgagcacagtgattcgtttcgtctgaataccaccaactacacccgtacgatctggaacagagatgcctatggtgttcctcctggatcaaatttgtacggcgcccaccctgtctactttgaccacaggggtccttcaggcactcacggtgtctttttgctgaattccaacgggattgaagcgaaaatcaacaacaccgatggtcagtacctggagtacaatgtccttggcggcattgtcgacctctatttcctcgcgggcccgactccgaaggatgtcagcaagcaatatgccgaagtagtgggacttcccgcaatgcaagcatactgggcctttggcttccaccagtgcagatatgggtaccgcgacgtctatgatgtcgcggaagtcgtcgccaactattcgctggccggcattcctctcgagaccatgtggacagacattgactacatggacctcaggaaagtctttacgctggacccggcgcgctttccgcttgagttggtgcgcgagttggtgaattatctgcacgcacatcaacagcactacatcgtcatggttgacccagcagtcgcctatcggaacaacacggcatacgatatcggggaccagcaggacgtattcctcaaagtttcgaacggctcctatttcattggagtggtctggcctggtccgacggtatttcctgactggttccaccccaacacccagccttactgggacgatcaattcgcaagcttcttcagcgccgacacaggagtagacatcgacgcgttgtggatcgacatgaacgaagcggccaacttttgcgtctttccctgttctgatcctttcggctacgcggaagcaaacaatcagccgccggacccgccgccagtgcgcgccaatagcggacgacccattcccggcttccctgccaactttcaacccggcggagttactccacctagcagggtcaggaccagacggcagacggctggtaccaaggccggcctgccgggacgagaccttctaaacccagaatataccattgcgaacttggctggcgtgatttccgcaaacaccatcaacacggatgtgatccaccataatggcttggccgagtacgacacgcacaacctgtacggcaccatgatgtcgacggcgagcagaatcgccatggagaagcgccgacctggcaggagaccgctggtaatcacccgcagcacctttgcaggcgctgggagggacgtagggcactggctaggggataatctttcggattgggagcattacagattctcgatttcccaacttcttcagtttgccgctctgtaccaggtgcctatggttggctctgatgtctgtgggttcgggtccaacacaacggagactttgtgcgcgagatgggcgctgctgggagcattttctacgttctacaggaatcacaatcaggacaacgcaatttcgcaggaattctacaggtggccgctggtgacggaggcggccaagaatgcaatcagcatacggtaccagctgcttgactacatctacaccgccttccaacggcagactcaaacgggtgagccagtggtcaacccgctattcttcaactatccaaccgacgcaaacacgttcggcatcgatttgcagtacttttacggagactcgattctcgtgagcccggtgacggaagagaacgtaactacggtcgacatctacctgccagatgacatcttttacgacttccacaccggcgagacggtgcgagggaacggctcgttcatcacgctccctgacgtcccatacacgaccattcccctgcacgtgaggggaggcagcatcatcccgctgcgagcggcatcagccaacacgacgacggagctgcgaaagcagaatttcacgctgctcattgctcccggtttggacggcacagccagtggcagcctgtacctggatgagggcgatgcgatcgcgcagccggccacgtcggagattcaattcaactacgacgggcagaagctggtgctgagcggatcgtttggatacaattcgggggtggtgataagcggggtgcgggtgctgggatcgtctggcaacggcacaacatcagcgggcaggatcatggcagctaaggcgccactgtcgattgcgctcgactcggcggcagagatagcattgtag

SEQ ID NO: 120 - protein, 887 aa, M. phaseolina
MLLDRLPLVAAFGSVCSAGAISVRQSSSGVDSCPGYTASNVVDSGTTLTADLSLAGASCNAYGDDLTDLKLNVEYQTANRLHVQIYDAAENVYQVPESVLPRPNAGNGSAAASAIQFKWVENPFSFSVVRTATNETLFDTADSPLVFETQYWRLRTKLPSEPNLYGLGEHSDSFRLNTTNYTRTIWNRDAYGVPPGSNLYGAHPVYFDHRGPSGTHGVFLLNSNGIEAKINNTDGQYLEYNVLGGIVDLYFLAGPTPKDVSKQYAEVVGLPAMQAYWAFGFHQCRYGYRDVYDVAEVVANYSLAGIPLETMWTDIDYMDLRKVFTLDPARFPLELVRELVNYLHAHQQHYIVMVDPAVAYRNNTAYDIGDQQDVFLKVSNGSYFIGVVWPGPTVFPDWFHPNTQPYWDDQFASFFSADTGVDIDALWIDMNEAANFCVFPCSDPFGYAEANNQPPDPPPVRANSGRPIPGFPANFQPGGVTPPSRVRTRRQTAGTKAGLPGRDLLNPEYTIANLAGVISANTINTDVIHHNGLAEYDTHNLYGTMMSTASRIAMEKRRPGRRPLVITRSTFAGAGRDVGHWLGDNLSDWEHYRFSISQLLQFAALYQVPMVGSDVCGFGSNTTETLCARWALLGAFSTFYRNHNQDNAISQEFYRWPLVTEAAKNAISIRYQLLDYIYTAFQRQTQTGEPVVNPLFFNYPTDANTFGIDLQYFYGDSILVSPVTEENVTTVDIYLPDDIFYDFHTGETVRGNGSFITLPDVPYTTIPLHVRGGSIIPLRAASANTTTELRKQNFTLLIAPGLDGTASGSLYLDEGDAIAQPATSEIQFNYDGQKLVLSGSFGYNSGVVISGVRVLGSSGNGTTSAGRIMAAKAPLSIALDSAAEIAL

SEQ ID NO: 121 - DNA, 2525 bp, M. phaseolina
cgggttgctgcctctcgctcggcctgcacagcaccgactccatcaaattatccgccggccgcctaccgcgctacataaaccgattaccgccttcatcatgtctttcttcgggaagcgcgtgcgccggacctaccgagagctcgagaaagcatgcgctgggcggctttcctgcttccgccagcagccattggagctgctgcgcaacatgccatctccgtcctaaccccggatccctacaccctcaccatcacacacaaaaacgagaccgtcctggaaagcatcaggatcctcaccgggaccttcaactacactgccgacttcgtctcagcatccgacgccggcgacatagccaatgcaggcggacgcatcaccagcaatttcgtgagcgacacagttgcgaaaatccagatcaacgccaacaacccctacgtgggcgctgacatcggagctggctcggacgcattgcgttacggtgtctgggagtatccttgggacggtaaggttgccaacgagaatgtgactttcgagatcaagggaattggggaggcaactggcgtgaactggtccaatgctcgtaggtcgctggagttcgagcaaccatccactgggcgttgctaaccgtctcaggggctcctttcttcttgtccagtgcgggctatggcatatacatcgacactctcgccatgggcctctttgatttcagcaattctgggagcacccgcttcgtcttcaatgccaccagtttgaccgtctacgccattttgccgaccgccccgggcgactacaagtccattctcacgcagtacgccaagctgtcatcctacatctatatgccgcccgataccgcatacgggcccatcgtctactccgacaactgggagaccgatttccacggcgatgtatccaacgcccaagagaactactacgacgtcgtcgaccatctcttcgacaatcacatccgtgcaagcgccatgttcgccgatcgcccttacggcaccggaaatggctcttggggcaacttcgacttcaatctcaccgcgtatcccactcccgcagacttcatcgccaacctctctgactggggatacgatttccaggcatgggttgccaaccgcgccacgcccggtacggtcctctggaatgcttcagttgtcaataactggcaattcgaattcgactatgcaacgctgcagggcggtctcgctggcccagccctcaatctctccatccctgaagcatacgcttttttctccgaccacctgcaagccttcaccgatctcggcgtccgcgggtacaaaatcgaccgtggagaagaagaagagatgccggtttgggagcaaaacatccagatgtccctgttcgaggaactctgttacgccaacatgttatccgcctggggtgaaggcaacttcttctccttcgctcgctccgtcttcgaccgttcccgcagccacgccgcagtctggaacggagacgcgcatgccaacttcacaggattggcctacagtgtcgccagcggtattcgtgctggacttttgggcttctccatgtggggttccgatactggcggctacatacgggagggtgaggagcctgtcccgacagaagaggtgtgggcgcgttggatgcattttgctaccttcagccccatgtatgagctcatgctcggaaccggtgcgactccctggtatgcgccgtatacctcagatctggttgctgtcttcagagagactgcggatctacatcatcaacttctgccgtacatccgcagctacacttacgccgcgcatactactggcctgcccgtcatgcgtgctctattcctcgaggagccagccgatgaggcctcttggattcattccgataacgagtacttcttcggtgcagagctgcttgtggctccggttgtgacggctgggggcacgcgagatgtctacttccccggctcaaatgagacgctttatctcgagtacctgaacaagagcagcgtttaccggggtggcgagacggtgtccgtggagcttggcgtccatgatgtacctgtatacgtcaaagcaggcgccattattccacgtggggacatcttcagggcaaatgatcggtggactgaagactggaaaccatatctagacctcgaggtgttcccatcgtttgatattcccaagtctcagttcaagtacttcaacaaggagaagaatgtgacggttgatataacgttgacaatggacgataagaaggcagaggtggagtatggcgagctgggtttcaatggcacagtgcttttctatttgaaggatggtgtgaagaaggtagacatcactccaagaggcgggggagcgatcgtatatggcgcccagtcactgttcaaagtgtaacgacaaagaatcagagagagtctgataagtgaattccggtacctggtagtgatctgtattcaattatctgccctctatcctgcgactgctcacaattccaactccgtccagagcgcactcctgtctctctatttcccttacaaacttccg

SEQ ID NO: 122 - DNA, 2172 bp, M. phaseolina
atgcgctgggcggctttcctgcttccgccagcagccattggagctgctgcgcaacatgccatctccgtcctaaccccggatccctacaccctcaccatcacacacaaaaacgagaccgtcctggaaagcatcaggatcctcaccgggaccttcaactacactgccgacttcgtctcagcatccgacgccggcgacatagccaatgcaggcggacgcatcaccagcaatttcgtgagcgacacagttgcgaaaatccagatcaacgccaacaacccctacgtgggcgctgacatcggagctggctcggacgcattgcgttacggtgtctgggagtatccttgggacggtaaggttgccaacgagaatgtgactttcgagatcaagggaattggggaggcaactggcgtgaactggtccaatgctcgggctcctttcttcttgtccagtgcgggctatggcatatacatcgacactctcgccatgggcctctttgatttcagcaattctgggagcacccgcttcgtcttcaatgccaccagtttgaccgtctacgccattttgccgaccgccccgggcgactacaagtccattctcacgcagtacgccaagctgtcatcctacatctatatgccgcccgataccgcatacgggcccatcgtctactccgacaactgggagaccgatttccacggcgatgtatccaacgcccaagagaactactacgacgtcgtcgaccatctcttcgacaatcacatccgtgcaagcgccatgttcgccgatcgcccttacggcaccggaaatggctcttggggcaacttcgacttcaatctcaccgcgtatcccactcccgcagacttcatcgccaacctctctgactggggatacgatttccaggcatgggttgccaaccgcgccacgcccggtacggtcctctggaatgcttcagttgtcaataactggcaattcgaattcgactatgcaacgctgcagggcggtctcgctggcccagccctcaatctctccatccctgaagcatacgcttttttctccgaccacctgcaagccttcaccgatctcggcgtccgcgggtacaaaatcgaccgtggagaagaagaagagatgccggtttgggagcaaaacatccagatgtccctgttcgaggaactctgttacgccaacatgttatccgcctggggtgaaggcaacttcttctccttcgctcgctccgtcttcgaccgttcccgcagccacgccgcagtctggaacggagacgcgcatgccaacttcacaggattggcctacagtgtcgccagcggtattcgtgctggacttttgggcttctccatgtggggttccgatactggcggctacatacgggagggtgaggagcctgtcccgacagaagaggtgtgggcgcgttggatgcattttgctaccttcagccccatgtatgagctcatgctcggaaccggtgcgactccctggtatgcgccgtatacctcagatctggttgctgtcttcagagagactgcggatctacatcatcaacttctgccgtacatccgcagctacacttacgccgcgcatactactggcctgcccgtcatgcgtgctctattcctcgaggagccagccgatgaggcctcttggattcattccgataacgagtacttcttcggtgcagagctgcttgtggctccggttgtgacggctgggggcacgcgagatgtctacttccccggctcaaatgagacgctttatctcgagtacctgaacaagagcagcgtttaccggggtggcgagacggtgtccgtggagcttggcgtccatgatgtacctgtatacgtcaaagcaggcgccattattccacgtggggacatcttcagggcaaatgatcggtggactgaagactggaaaccatatctagacctcgaggtgttcccatcgtttgatattcccaagtctcagttcaagtacttcaacaaggagaagaatgtgacggttgatataacgttgacaatggacgataagaaggcagaggtggagtatggcgagctgggtttcaatggcacagtgcttttctatttgaaggatggtgtgaagaaggtagacatcactccaagaggcgggggagcgatcgtatatggcgcccagtcactgttcaaagtgtaa

SEQ ID NO: 123 - protein, 723 aa, M. phaseolina
MRWAAFLLPPAAIGAAAQHAISVLTPDPYTLTITHKNETVLESIRILTGTFNYTADFVSASDAGDIANAGGRITSNFVSDTVAKIQINANNPYVGADIGAGSDALRYGVWEYPWDGKVANENVTFEIKGIGEATGVNWSNARAPFFLSSAGYGIYIDTLAMGLFDFSNSGSTRFVFNATSLTVYAILPTAPGDYKSILTQYAKLSSYIYMPPDTAYGPIVYSDNWETDFHGDVSNAQENYYDVVDHLFDNHIRASAMFADRPYGTGNGSWGNFDFNLTAYPTPADFIANLSDWGYDFQAWVANRATPGTVLWNASVVNNWQFEFDYATLQGGLAGPALNLSIPEAYAFFSDHLQAFTDLGVRGYKIDRGEEEEMPVWEQNIQMSLFEELCYANMLSAWGEGNFFSFARSVFDRSRSHAAVWNGDAHANFTGLAYSVASGIRAGLLGFSMWGSDTGGYIREGEEPVPTEEVWARWMHFATFSPMYELMLGTGATPWYAPYTSDLVAVFRETADLHHQLLPYIRSYTYAAHTTGLPVMRALFLEEPADEASWIHSDNEYFFGAELLVAPVVTAGGTRDVYFPGSNETLYLEYLNKSSVYRGGETVSVELGVHDVPVYVKAGAIIPRGDIFRANDRWTEDWKPYLDLEVFPSFDIPKSQFKYFNKEKNVTVDITLTMDDKKAEVEYGELGFNGTVLFYLKDGVKKVDITPRGGGAIVYGAQSLFKV

SEQ ID NO: 124 - DNA, 2594 bp, M. phaseolina
ggctgagtatgttttgacaggcattaggacgtcattgctcaccagatctcgcgggatgctcaccgtactcggacataaattgaacgacagcaggccattggtgcagcagacgagctcgcctggcacgtcgtcatatcaccatccaccataatgcatcttctctatagtctcgtctccttgcctcttctcactgtttctgcccagaatatcacttcggagtacttcgcaccgaactctacgggctttcgtatgacacatgggttcgagactattctcgtccaaccgtacggttacgatggctttcgtgtcagagcatggcccttccggcctccaaacggcaatgagatcagcttcctctatgatccgccacttgaagggcctgagaatggagaagcccgagcaatgagctatgatttcactaccaatggcaatcagagcgccatcattcgcaatggtaacaccgtcgtcaagacatacggcctcgagggtgctcactaccgtctggccttctaccgcatcgagcctgatgggacagaaacgctactcacgaatgagttcaacccggtcaaggctctcaaccccagatactactcctggaccagcaccgggtacgagttctctgcctcgttttctttcactacaactccagacgaacagatattcgggaccggcactcaacaggattttctgctgaacaagaaaggctccgtcatcgacatgattaatttcaactcgtacattccgactcccgttttcatgtccagcaagggctacggatttgtgtggaactctgccgctcaaggccgaatggagtttgggccacgccgcaacaagttcacgtcggactccacaacgctcgtcgactatgccattgtcagtgccccggaaggcgactacgattcgctccagcagaagctcactgccattaccggccgtgcgccgacgcctcctgacttttccctcggctacctccactcgaaactgcggtacgaaaaccaaacggaagtcgttcttcttgctcaggggttccgtgaccgcaatatcccagtctccatgatagtcattgactacgagtcctgggctcagaacggtgattgggggctggatcctgctctctggccggatgtcgcttcgatggcggcacaggtcaagaacttgactggcgcggagatgatggcttcgctgtggccggcggtggaagatgatagcctgaactacgctgagatgcagcagttgggcctgctcgcagcaacaatgtcggggccgggcacaaccgactcgtggaatggcagttacatcaggaactacgacagcacgaacccgcgcgcccgcgagttcctgtggaacacactgaagcggaattactacgacaaggggatcaagaacttctggatcgaccaagcagatggcggagctttgggagaggcgtgggagaacaacggccagaccgcttacgttcaatccatcccgtatccgctgcctcaggtactctaccatgccggcacgcaggcatcagttgggaagctctacccttgggcacaccaacaggccattgaggaagggacgcgcaatgctaccgggactgagcaaggcacagcgtaggtctcactgttcccctgccctcttagacgcgaagtgccggattcttcgtgctgacatgacacagctgcgactacatatcgctcagccgctcgggctacatcggctcgcagcgcttctgcagcatgatctggtcgggcgacaccgaggccagctgggaggtgctgggtaaccagatccctaacgcgctgagcgcggcggcaacggggtggtcgtggtacacggtcgacgcgggcggcttccagccggaccctgccatcgagtggtccaacaacatcgaccggcccgagtaccgcgagctgtacgtgcgctggctgcagtggaccaccttcttgcccttcatgcgcaaccacggctcgcgcgcctgcgatgtccagcacgccttcacctgcgacaacgagccgtggacgtacggcgcccagaacacgccgaccatcgtctcgtacatcaacctgcgctaccgcctcgccccctacgtgcgcgcgctgttcgagcagctctcgcgcacaggcaggcagatcctgcggccgctgttcatggacttcggcaagagcgatgcgaacgtcgtggcctggacgagggagaacaagaacatcacgacgcagcagtacatgttcggcccccggctgctcgtcgcgcctgtggtgctgccgaacgtgacgacgtggcctgtgtatctgcccaagacggcgggtgaggggagtgggcagaggccgtggacgtattggtggacgaacgagacgtttgcgggcgggcagacggtgaacgtgagcgcgccggtggaacatatccccttgttctacctgggtgatagggacgacatattctccggaaacgtgttttagaattgagcgaaaagggtggcagtgagtgaatgcgaaatggcaattcgagtacattgcctcacgtattttgatgccgatttattctgagaatatgcattgccattgaactaatctacatatccgcccgactagtctcggacaaacttctga

SEQ ID NO: 125 - DNA, 2226 bp, M. phaseolina
atgcatcttctctatagtctcgtctccttgcctcttctcactgtttctgcccagaatatcacttcggagtacttcgcaccgaactctacgggctttcgtatgacacatgggttcgagactattctcgtccaaccgtacggttacgatggctttcgtgtcagagcatggcccttccggcctccaaacggcaatgagatcagcttcctctatgatccgccacttgaagggcctgagaatggagaagcccgagcaatgagctatgatttcactaccaatggcaatcagagcgccatcattcgcaatggtaacaccgtcgtcaagacatacggcctcgagggtgctcactaccgtctggccttctaccgcatcgagcctgatgggacagaaacgctactcacgaatgagttcaacccggtcaaggctctcaaccccagatactactcctggaccagcaccgggtacgagttctctgcctcgttttctttcactacaactccagacgaacagatattcgggaccggcactcaacaggattttctgctgaacaagaaaggctccgtcatcgacatgattaatttcaactcgtacattccgactcccgttttcatgtccagcaagggctacggatttgtgtggaactctgccgctcaaggccgaatggagtttgggccacgccgcaacaagttcacgtcggactccacaacgctcgtcgactatgccattgtcagtgccccggaaggcgactacgattcgctccagcagaagctcactgccattaccggccgtgcgccgacgcctcctgacttttccctcggctacctccactcgaaactgcggtacgaaaaccaaacggaagtcgttcttcttgctcaggggttccgtgaccgcaatatcccagtctccatgatagtcattgactacgagtcctgggctcagaacggtgattgggggctggatcctgctctctggccggatgtcgcttcgatggcggcacaggtcaagaacttgactggcgcggagatgatggcttcgctgtggccggcggtggaagatgatagcctgaactacgctgagatgcagcagttgggcctgctcgcagcaacaatgtcggggccgggcacaaccgactcgtggaatggcagttacatcaggaactacgacagcacgaacccgcgcgcccgcgagttcctgtggaacacactgaagcggaattactacgacaaggggatcaagaacttctggatcgaccaagcagatggcggagctttgggagaggcgtgggagaacaacggccagaccgcttacgttcaatccatcccgtatccgctgcctcaggtactctaccatgccggcacgcaggcatcagttgggaagctctacccttgggcacaccaacaggccattgaggaagggacgcgcaatgctaccgggactgagcaaggcacagcctgcgactacatatcgctcagccgctcgggctacatcggctcgcagcgcttctgcagcatgatctggtcgggcgacaccgaggccagctgggaggtgctgggtaaccagatccctaacgcgctgagcgcggcggcaacggggtggtcgtggtacacggtcgacgcgggcggcttccagccggaccctgccatcgagtggtccaacaacatcgaccggcccgagtaccgcgagctgtacgtgcgctggctgcagtggaccaccttcttgcccttcatgcgcaaccacggctcgcgcgcctgcgatgtccagcacgccttcacctgcgacaacgagccgtggacgtacggcgcccagaacacgccgaccatcgtctcgtacatcaacctgcgctaccgcctcgccccctacgtgcgcgcgctgttcgagcagctctcgcgcacaggcaggcagatcctgcggccgctgttcatggacttcggcaagagcgatgcgaacgtcgtggcctggacgagggagaacaagaacatcacgacgcagcagtacatgttcggcccccggctgctcgtcgcgcctgtggtgctgccgaacgtgacgacgtggcctgtgtatctgcccaagacggcgggtgaggggagtgggcagaggccgtggacgtattggtggacgaacgagacgtttgcgggcgggcagacggtgaacgtgagcgcgccggtggaacatatccccttgttctacctgggtgatagggacgacatattctccggaaacgtgttttag

SEQ ID NO: 126 - protein, 741 aa, M. phaseolina
MHLLYSLVSLPLLTVSAQNITSEYFAPNSTGFRMTHGFETILVQPYGYDGFRVRAWPFRPPNGNEISFLYDPPLEGPENGEARAMSYDFTTNGNQSAIIRNGNTVVKTYGLEGAHYRLAFYRIEPDGTETLLTNEFNPVKALNPRYYSWTSTGYEFSASFSFTTTPDEQIFGTGTQQDFLLNKKGSVIDMINFNSYIPTPVFMSSKGYGFVWNSAAQGRMEFGPRRNKFTSDSTTLVDYAIVSAPEGDYDSLQQKLTAITGRAPTPPDFSLGYLHSKLRYENQTEVVLLAQGFRDRNIPVSMIVIDYESWAQNGDWGLDPALWPDVASMAAQVKNLTGAEMMASLWPAVEDDSLNYAEMQQLGLLAATMSGPGTTDSWNGSYIRNYDSTNPRAREFLWNTLKRNYYDKGIKNFWIDQADGGALGEAWENNGQTAYVQSIPYPLPQVLYHAGTQASVGKLYPWAHQQAIEEGTRNATGTEQGTACDYISLSRSGYIGSQRFCSMIWSGDTEASWEVLGNQIPNALSAAATGWSWYTVDAGGFQPDPAIEWSNNIDRPEYRELYVRWLQWTTFLPFMRNHGSRACDVQHAFTCDNEPWTYGAQNTPTIVSYINLRYRLAPYVRALFEQLSRTGRQILRPLFMDFGKSDANVVAWTRENKNITTQQYMFGPRLLVAPVVLPNVTTWPVYLPKTAGEGSGQRPWTYWWTNETFAGGQTVNVSAPVEHIPLFYLGDRDDIFSGNVF

SEQ ID NO: 127 - DNA, 3385 bp, M. phaseolina
gctcaccgccttggccatcacgtgccgccaagctctctccgcgctccggggaaagctgtcatctacgccgagggagctgtctcgactccaaccactgcttcactgctccagacctcgctgcatccggactgcagcctggtatcgcccatcatgccgtccgcagcacccaagtcccgtcgttggacctcttttttgcttgtcgttgctgtcgtttgtcttctgtttacacctgcaggtacgccgcctcgcccgagagcttcctgagctccactgcacgtccaccctggctgacaaccgcaacacagcgtccgtcaaacacgagaatttcaagacctgcagccagtccggcttctgtaagcgcaacagagcctttgccgataatgcccaagaactgtcctccgcctggcaatcgccctacaccctcgaccccgcctccatcgccttcaaccagggccaattgtccgctacagtcctcaagaaggtcaatgataacgaccaggtccgcctgccacttaccctgaccttcctggagtccggcaccgctcggttcactctcgatgaggagaagcggcagaagggcgacatcgagctccgccatgacagcaaggctcgcaaggagcgttacaatgaagccgagaagtgggccatcgttggtggtcttgatgtcagcaccggtgctgccatcagctccgaggctgacgagggtgtgaccaaggtcgtctatggtccgggcggcaagtttgaggctgtcatacatcactctcccctggccgtcgacttcaagcgtgacggacagacccaagtcaagttcaatgaccgcggctttctcaacttggagcactggaggcccaagattgagaaagagaaaaaggaaggcgaggagggtgctgccgaggaggccgcccccgagcctaccgaggacgagagcacctggtgggatgagtcctttggtggaaacaccgactccaagccaagaggacctgaggctgttgctttggacattaccttccccgactacgcccacgtatacggtattcccgagcatgccagctctctgtccctcaaggagactcggtaagctttattctcagacactgccaagcttcggctgactttctttagtggtggtgacggcgcctactctgagccttaccgactctacaatgccgatgtgttcgagtatgagatggacagccctatgactctctatggatccatccctttcatgcaggcacaccgcaaggactccaccgtcggtgtcttctggctcaatgctgcggagacctgggtcgacatcgtcaagtccaagagcgctgccaacgctctcagtctcggtgttgctggccatactgacaccaaaacccactggatctccgaaagtggtctcctcgatgtcttcgttttccttggccctgaacccaaggatgtcataaagagctacagcgagctgaccggctacactcagcttccccaggagtttgccattgcctaccatcagtgcaggtggaactacgtcactgatgaagatgtcatggacgttgaccgcaagttcgacaagcacaacattccgtatgatgttatttggctcgacattgagtacactcacgaaaagaaatacttcacctgggaccccatgactttccccaagaccaaggaaatgcacgaccagcttgataagcacgaccgtaagcttgttgctattattgatcctcacatcaagaacgttgccgattatcccatcgttgaagagctcaaaagcaaggaacttgctgctaagaacaaggatggcaaccagtacgagggttggtgctggcctggctcttcgtactgggtcgactgcttcaaccctgccgctgtcgattggtggaagagcctcttcaagtacgataaattccagggctctgccccgaacaccttcatctggaacgacatgaatgagccttctgtcttcaacggccctgagaccaccatgcccaaggacaacatgcacttcggcaactgggaacaccgtgatgtccacaacatcaacggcatgacattccacaatgccacttacgaagccatcattgagcgcaagaagggtgaggttcgccgcccttttgtccttactcgttccttctatgcaggtagccagagactcggcgccatgtggaccggagacaaccaggccaactgggatcacctcgcggcctcgattcccatgaccctcaaccagggcatttcgggcttccctttcgctggcgctgatgttggtggttttttcggcaatccggagaaggatctcctgacccgttggtaccaagcaggtgccttctatcccttcttccgtggtcacgcccacattgatacccgccgccgtgagccctatctggccggctctccctacactgagatcatcactcaggctctccgcctacgctactctctcatgccgacctggtacactgccttccacgaggccagtgtcaacggtgctcccattatccgccccaactactacgtccaccccactgatgagaagggttttgccattgatgaccagctttacctgggttcgactggcctcctcgccaagcccgttgtcacggagggtgctgacagcgttgacatttatatcgccgacgatgagccttactacgactactttgactacactatctacactggcccgggcagcaagtctattcctgcgcctctcgagaagatccctctcctcatgcagggcggtcacatcatcccccgccgcgaccgtccgcgccgcagctccggcctcatgaagtacgacccctacacgctagtcgtgaccattggcaaggacggcaaagctgagggcgagctctacgttgacgacggcgagacgttcgactaccagcagggtgcctacatctaccgccgcttcttgttcgacaagcccacccacgccctcacctccatcgacatttccacttctggccccaagacagctacgtatctcaagagtatggcaaaggttcgcgttgaaaaggtcgtcattgtcggcgcccctgatgagtgggagagattggagagtgtgtttgtaagtgaggaaggcgcaaaggagagccagaggaggaggaaggttccgattaagttcaccaagggtaaggatggtaaagccagctttgcggtggtaagggatccgaaggtcagtatcgcgaaaggctggaagattgattttggtggtgagaacgaggagcatcatgggcatgctcattagacggcttggaaagggaatggaaagagatggtgtggaagatgtggaattgggaaaaagggtcatgatagatatgatgcattgtctgtgagaattttagaggcgtgtctttgttgtactgcgggtgtttccgtgtttcgattggttgagcgg

SEQ ID NO: 128 - DNA, 2967 bp, M. phaseolina
atgccgtccgcagcacccaagtcccgtcgttggacctcttttttgcttgtcgttgctgtcgtttgtcttctgtttacacctgcagcgtccgtcaaacacgagaatttcaagacctgcagccagtccggcttctgtaagcgcaacagagcctttgccgataatgcccaagaactgtcctccgcctggcaatcgccctacaccctcgaccccgcctccatcgccttcaaccagggccaattgtccgctacagtcctcaagaaggtcaatgataacgaccaggtccgcctgccacttaccctgaccttcctggagtccggcaccgctcggttcactctcgatgaggagaagcggcagaagggcgacatcgagctccgccatgacagcaaggctcgcaaggagcgttacaatgaagccgagaagtgggccatcgttggtggtcttgatgtcagcaccggtgctgccatcagctccgaggctgacgagggtgtgaccaaggtcgtctatggtccgggcggcaagtttgaggctgtcatacatcactctcccctggccgtcgacttcaagcgtgacggacagacccaagtcaagttcaatgaccgcggctttctcaacttggagcactggaggcccaagattgagaaagagaaaaaggaaggcgaggagggtgctgccgaggaggccgcccccgagcctaccgaggacgagagcacctggtgggatgagtcctttggtggaaacaccgactccaagccaagaggacctgaggctgttgctttggacattaccttccccgactacgcccacgtatacggtattcccgagcatgccagctctctgtccctcaaggagactcgtggtggtgacggcgcctactctgagccttaccgactctacaatgccgatgtgttcgagtatgagatggacagccctatgactctctatggatccatccctttcatgcaggcacaccgcaaggactccaccgtcggtgtcttctggctcaatgctgcggagacctgggtcgacatcgtcaagtccaagagcgctgccaacgctctcagtctcggtgttgctggccatactgacaccaaaacccactggatctccgaaagtggtctcctcgatgtcttcgttttccttggccctgaacccaaggatgtcataaagagctacagcgagctgaccggctacactcagcttccccaggagtttgccattgcctaccatcagtgcaggtggaactacgtcactgatgaagatgtcatggacgttgaccgcaagttcgacaagcacaacattccgtatgatgttatttggctcgacattgagtacactcacgaaaagaaatacttcacctgggaccccatgactttccccaagaccaaggaaatgcacgaccagcttgataagcacgaccgtaagcttgttgctattattgatcctcacatcaagaacgttgccgattatcccatcgttgaagagctcaaaagcaaggaacttgctgctaagaacaaggatggcaaccagtacgagggttggtgctggcctggctcttcgtactgggtcgactgcttcaaccctgccgctgtcgattggtggaagagcctcttcaagtacgataaattccagggctctgccccgaacaccttcatctggaacgacatgaatgagccttctgtcttcaacggccctgagaccaccatgcccaaggacaacatgcacttcggcaactgggaacaccgtgatgtccacaacatcaacggcatgacattccacaatgccacttacgaagccatcattgagcgcaagaagggtgaggttcgccgcccttttgtccttactcgttccttctatgcaggtagccagagactcggcgccatgtggaccggagacaaccaggccaactgggatcacctcgcggcctcgattcccatgaccctcaaccagggcatttcgggcttccctttcgctggcgctgatgttggtggttttttcggcaatccggagaaggatctcctgacccgttggtaccaagcaggtgccttctatcccttcttccgtggtcacgcccacattgatacccgccgccgtgagccctatctggccggctctccctacactgagatcatcactcaggctctccgcctacgctactctctcatgccgacctggtacactgccttccacgaggccagtgtcaacggtgctcccattatccgccccaactactacgtccaccccactgatgagaagggttttgccattgatgaccagctttacctgggttcgactggcctcctcgccaagcccgttgtcacggagggtgctgacagcgttgacatttatatcgccgacgatgagccttactacgactactttgactacactatctacactggcccgggcagcaagtctattcctgcgcctctcgagaagatccctctcctcatgcagggcggtcacatcatcccccgccgcgaccgtccgcgccgcagctccggcctcatgaagtacgacccctacacgctagtcgtgaccattggcaaggacggcaaagctgagggcgagctctacgttgacgacggcgagacgttcgactaccagcagggtgcctacatctaccgccgcttcttgttcgacaagcccacccacgccctcacctccatcgacatttccacttctggccccaagacagctacgtatctcaagagtatggcaaaggttcgcgttgaaaaggtcgtcattgtcggcgcccctgatgagtgggagagattggagagtgtgtttgtaagtgaggaaggcgcaaaggagagccagaggaggaggaaggttccgattaagttcaccaagggtaaggatggtaaagccagctttgcggtggtaagggatccgaaggtcagtatcgcgaaaggctggaagattgattttggtggtgagaacgaggagcatcatgggcatgctcattag

SEQ ID NO: 129 - protein, 988 aa, M. phaseolina
MPSAAPKSRRWTSFLLVVAVVCLLFTPAASVKHENFKTCSQSGFCKRNRAFADNAQELSSAWQSPYTLDPASIAFNQGQLSATVLKKVNDNDQVRLPLTLTFLESGTARFTLDEEKRQKGDIELRHDSKARKERYNEAEKWAIVGGLDVSTGAAISSEADEGVTKVVYGPGGKFEAVIHHSPLAVDFKRDGQTQVKFNDRGFLNLEHWRPKIEKEKKEGEEGAAEEAAPEPTEDESTWWDESFGGNTDSKPRGPEAVALDITFPDYAHVYGIPEHASSLSLKETRGGDGAYSEPYRLYNADVFEYEMDSPMTLYGSIPFMQAHRKDSTVGVFWLNAAETWVDIVKSKSAANALSLGVAGHTDTKTHWISESGLLDVFVFLGPEPKDVIKSYSELTGYTQLPQEFAIAYHQCRWNYVTDEDVMDVDRKFDKHNIPYDVIWLDIEYTHEKKYFTWDPMTFPKTKEMHDQLDKHDRKLVAIIDPHIKNVADYPIVEELKSKELAAKNKDGNQYEGWCWPGSSYWVDCFNPAAVDWWKSLFKYDKFQGSAPNTFIWNDMNEPSVFNGPETTMPKDNMHFGNWEHRDVHNINGMTFHNATYEAIIERKKGEVRRPFVLTRSFYAGSQRLGAMWTGDNQANWDHLAASIPMTLNQGISGFPFAGADVGGFFGNPEKDLLTRWYQAGAFYPFFRGHAHIDTRRREPYLAGSPYTEIITQALRLRYSLMPTWYTAFHEASVNGAPIIRPNYYVHPTDEKGFAIDDQLYLGSTGLLAKPVVTEGADSVDIYIADDEPYYDYFDYTIYTGPGSKSIPAPLEKIPLLMQGGHIIPRRDRPRRSSGLMKYDPYTLVVTIGKDGKAEGELYVDDGETFDYQQGAYIYRRFLFDKPTHALTSIDISTSGPKTATYLKSMAKVRVEKVVIVGAPDEWERLESVFVSEEGAKESQRRRKVPIKFTKGKDGKASFAVVRDPKVSIAKGWKIDFGGENEEHHGHAH

SEQ ID NO: 130 - DNA, 3383 bp, M. phaseolina
cgcagcactgcttggcctgctctggtgcttatattgtcttgtttcccctccccggtcttggtcacgcacgctccattcgcactccagcatcccgtctgaagggccggtcgtgtttccttggtctactcttgtcccaatctcctgtttccaatggcaccttcgccgctgcctggcctacgggcactggcacgctcggtgctgaccgttgtgagcattgctcaggcacaatcgagtctgtcttcttcagctgggcaggacggagtggccgcgtctgcgacgacagtcacggcttccgccaccgcctaccgccccaagttcaccgttccggctgacgccgacgtcgggcaaaacctcatccccaacatcgaagacccgcaggccgtcgatgcccaaaccgtttgcccgggctacaaggcgtccggcgtgcgccgagatgcctacggtttcgcggcaaccctgagcctcgccggacatgcttgcaatgtgtacggcaccgatatcgagacgttgaaccttactgtgcagtatcagaacgccgatcgccttgccatcaacattagtccggccaatatcgatgcctcaaattcgtcgcattacatcctccccgagcaagtcattccgcggccggtcctggacgccgatgcagactcgtccattcgggaaaacgactttcaggtcgcctggagcaacgaccccagcttctctttcactgtcattaggcggtcgactggtgatgtggtgttcagcaccgaaggcagtgtcctggtttacgaggatcagttcgttgagttcgtaacttccatgcccgcggaatacaacatctacggccttggagagcgcatccatggcctgcgtctcggaactaacttcaccgccaccatctacgctgccgacgttggagatcccattgatgacaacatctatgggagccaccctttctacctcgacaccagatacttcgaggtcgattctgctactgggaacttgacctacgtttccaacgctcctgatgccgcctcgaatgcttcctttgtctcctactcccacggcgttttcctccgcaacgcccacggtcaggagattcttctcagaccagacaacgtcacctggcgcactctcggtggtagcatcgatcttttcttcttcgacggcccgtcccaaccagaggtcacgaagcagtaccagcacggcgccgtcggtcttccggcaatgcagcagtacttcacctttggataccatcagtgccgctggggatacgccaattggtcccaattcgaggaggttgtcgacaacttcatcaagttcgagatcccgctggagaacatttggctcgacatcgactacatgctggagtacagggatttcacttccgaccccaacaccttccccgtgaaagagggtctcgacgtgctgcagcgcctgcatgatggcggacggcattttatccccattgttgacagtgctatctacattcccaatccggagaacgagaccgatgcatatgccacttacaccaggggcaatgagtctggagccttcctgaagaatcccgacggcagtgaatacatcggcgccgtgtggcctggttacaccgtgttccctgactggttgatcgacacggccgttccgtggtggtccgacgagctggtacggtggcacaaagaggttccctttgatggaatttggatcgacatgtccgaggtctcttccttctgcgtcggctcctgtggctccggtaacctctcgctcaaccctgcgcaccctcctttctctctcccgggtgagccaggaaacgtcatctatgattacccggagggcttcaacatcacgaacgccactgaagctgcgtcggcttcatctgcttcctctagccaagccgcagcaacatcctctgctgcttcaagctcaggcacgacgagctatctccggactactcccactcctggtgtgagaaacgtcaactacccgccttatgtcattgacaatgtccagggtgatctggctgtgcatgccgtttcccctaatgctactcacttcaatggcgtcgaagagtacgatgtgcataatctcttcggccaccagatcctgaatgccacataccaaggcctgctcgatgtgtttcccgggaagaggccattcatcatcggccgttccacatttgctggatccggcaagtgggccggacactggggtggcgacaagtgagtatatacacatattctaccggaagaaatcttgactgacatggatttcgcgccagctactccaaatgggcgtacatgtacttcggcatcccgcaagctctgtccttcagtctcttcggcatccccatgttcggcgtcgacacgtgcggcttcaacggcaatagcgatgaggagctgtgcaatcggtggatgcagctgtccgccttctttcccttctaccgcaaccacaacacattgagcgccaaatcgcaagagccatacgtgtggtcctcggtcatcgacgcgtcgaagaaggccatggccatccgctacgccctgctgccctacctctacaccctcttccacgccgcgcattccactggcgccacagtcatgcgcgccctcgcctgggagttcccagacgacccgtcccttgccaacgtggacactcagttcctcctcggccccagcctcctcgtcacccccgtcctcgctcccaacgcctccactgtccgcggcgtctttccaggcaggggcgccgagaagtggtacgactggtactcgcagcaggtcgttgacgtcttgcccggcgagaacaaaactctcgacgccccgctcggccatattcctgtcttcgtgcgcggcggcagcatattgccactgcaggaaccgcggctcacgacgaaagaggcgcggcggacgccgtgggcgctgctggtagcgttgggcaaaggcagcacggcgaagggcgagctatacctcgatgatggagagagcctgaacccgaatgagacgctgagcgtggcgttcgtggcagagagggagagcttgagcgcgagtgcggtagggttgttcagggatgggaatgcgttggcgaatgtgacggtgctgggcgttgcgagcgagcccagtgctgtgaggattggtggcgtggatgttgggaaggggaggtgggcgtggagtaggacgagtaaggtgttgagtgttacgcggttggatgaggtggtgaagggtggggcgtgggatgtggattggacgcttacctggtagaggagttgggtgggtgcattagaaggcctcgagacgggtaggccaggtgttactgcttttcatgacgggggggctctttgaaaagagaaagatggcaatagcacaagagcttgggaagacgagaagacggaaagggagattggacgaaag

SEQ ID NO: 131 - DNA, 3024 bp, M. phaseolina
atggcaccttcgccgctgcctggcctacgggcactggcacgctcggtgctgaccgttgtgagcattgctcaggcacaatcgagtctgtcttcttcagctgggcaggacggagtggccgcgtctgcgacgacagtcacggcttccgccaccgcctaccgccccaagttcaccgttccggctgacgccgacgtcgggcaaaacctcatccccaacatcgaagacccgcaggccgtcgatgcccaaaccgtttgcccgggctacaaggcgtccggcgtgcgccgagatgcctacggtttcgcggcaaccctgagcctcgccggacatgcttgcaatgtgtacggcaccgatatcgagacgttgaaccttactgtgcagtatcagaacgccgatcgccttgccatcaacattagtccggccaatatcgatgcctcaaattcgtcgcattacatcctccccgagcaagtcattccgcggccggtcctggacgccgatgcagactcgtccattcgggaaaacgactttcaggtcgcctggagcaacgaccccagcttctctttcactgtcattaggcggtcgactggtgatgtggtgttcagcaccgaaggcagtgtcctggtttacgaggatcagttcgttgagttcgtaacttccatgcccgcggaatacaacatctacggccttggagagcgcatccatggcctgcgtctcggaactaacttcaccgccaccatctacgctgccgacgttggagatcccattgatgacaacatctatgggagccaccctttctacctcgacaccagatacttcgaggtcgattctgctactgggaacttgacctacgtttccaacgctcctgatgccgcctcgaatgcttcctttgtctcctactcccacggcgttttcctccgcaacgcccacggtcaggagattcttctcagaccagacaacgtcacctggcgcactctcggtggtagcatcgatcttttcttcttcgacggcccgtcccaaccagaggtcacgaagcagtaccagcacggcgccgtcggtcttccggcaatgcagcagtacttcacctttggataccatcagtgccgctggggatacgccaattggtcccaattcgaggaggttgtcgacaacttcatcaagttcgagatcccgctggagaacatttggctcgacatcgactacatgctggagtacagggatttcacttccgaccccaacaccttccccgtgaaagagggtctcgacgtgctgcagcgcctgcatgatggcggacggcattttatccccattgttgacagtgctatctacattcccaatccggagaacgagaccgatgcatatgccacttacaccaggggcaatgagtctggagccttcctgaagaatcccgacggcagtgaatacatcggcgccgtgtggcctggttacaccgtgttccctgactggttgatcgacacggccgttccgtggtggtccgacgagctggtacggtggcacaaagaggttccctttgatggaatttggatcgacatgtccgaggtctcttccttctgcgtcggctcctgtggctccggtaacctctcgctcaaccctgcgcaccctcctttctctctcccgggtgagccaggaaacgtcatctatgattacccggagggcttcaacatcacgaacgccactgaagctgcgtcggcttcatctgcttcctctagccaagccgcagcaacatcctctgctgcttcaagctcaggcacgacgagctatctccggactactcccactcctggtgtgagaaacgtcaactacccgccttatgtcattgacaatgtccagggtgatctggctgtgcatgccgtttcccctaatgctactcacttcaatggcgtcgaagagtacgatgtgcataatctcttcggccaccagatcctgaatgccacataccaaggcctgctcgatgtgtttcccgggaagaggccattcatcatcggccgttccacatttgctggatccggcaagtgggccggacactggggtggcgacaactactccaaatgggcgtacatgtacttcggcatcccgcaagctctgtccttcagtctcttcggcatccccatgttcggcgtcgacacgtgcggcttcaacggcaatagcgatgaggagctgtgcaatcggtggatgcagctgtccgccttctttcccttctaccgcaaccacaacacattgagcgccaaatcgcaagagccatacgtgtggtcctcggtcatcgacgcgtcgaagaaggccatggccatccgctacgccctgctgccctacctctacaccctcttccacgccgcgcattccactggcgccacagtcatgcgcgccctcgcctgggagttcccagacgacccgtcccttgccaacgtggacactcagttcctcctcggccccagcctcctcgtcacccccgtcctcgctcccaacgcctccactgtccgcggcgtctttccaggcaggggcgccgagaagtggtacgactggtactcgcagcaggtcgttgacgtcttgcccggcgagaacaaaactctcgacgccccgctcggccatattcctgtcttcgtgcgcggcggcagcatattgccactgcaggaaccgcggctcacgacgaaagaggcgcggcggacgccgtgggcgctgctggtagcgttgggcaaaggcagcacggcgaagggcgagctatacctcgatgatggagagagcctgaacccgaatgagacgctgagcgtggcgttcgtggcagagagggagagcttgagcgcgagtgcggtagggttgttcagggatgggaatgcgttggcgaatgtgacggtgctgggcgttgcgagcgagcccagtgctgtgaggattggtggcgtggatgttgggaaggggaggtgggcgtggagtaggacgagtaaggtgttgagtgttacgcggttggatgaggtggtgaagggtggggcgtgggatgtggattggacgcttacctggtag

SEQ ID NO: 132 - protein, 1007 aa, M. phaseolina
MAPSPLPGLRALARSVLTVVSIAQAQSSLSSSAGQDGVAASATTVTASATAYRPKFTVPADADVGQNLIPNIEDPQAVDAQTVCPGYKASGVRRDAYGFAATLSLAGHACNVYGTDIETLNLTVQYQNADRLAINISPANIDASNSSHYILPEQVIPRPVLDADADSSIRENDFQVAWSNDPSFSFTVIRRSTGDVVFSTEGSVLVYEDQFVEFVTSMPAEYNIYGLGERIHGLRLGTNFTATIYAADVGDPIDDNIYGSHPFYLDTRYFEVDSATGNLTYVSNAPDAASNASFVSYSHGVFLRNAHGQEILLRPDNVTWRTLGGSIDLFFFDGPSQPEVTKQYQHGAVGLPAMQQYFTFGYHQCRWGYANWSQFEEVVDNFIKFEIPLENIWLDIDYMLEYRDFTSDPNTFPVKEGLDVLQRLHDGGRHFIPIVDSAIYIPNPENETDAYATYTRGNESGAFLKNPDGSEYIGAVWPGYTVFPDWLIDTAVPWWSDELVRWHKEVPFDGIWIDMSEVSSFCVGSCGSGNLSLNPAHPPFSLPGEPGNVIYDYPEGFNITNATEAASASSASSSQAAATSSAASSSGTTSYLRTTPTPGVRNVNYPPYVIDNVQGDLAVHAVSPNATHFNGVEEYDVHNLFGHQILNATYQGLLDVFPGKRPFIIGRSTFAGSGKWAGHWGGDNYSKWAYMYFGIPQALSFSLFGIPMFGVDTCGFNGNSDEELCNRWMQLSAFFPFYRNHNTLSAKSQEPYVWSSVIDASKKAMAIRYALLPYLYTLFHAAHSTGATVMRALAWEFPDDPSLANVDTQFLLGPSLLVTPVLAPNASTVRGVFPGRGAEKWYDWYSQQVVDVLPGENKTLDAPLGHIPVFVRGGSILPLQEPRLTTKEARRTPWALLVALGKGSTAKGELYLDDGESLNPNETLSVAFVAERESLSASAVGLFRDGNALANVTVLGVASEPSAVRIGGVDVGKGRWAWSRTSKVLSVTRLDEVVKGGAWDVDWTLTW

SEQ ID NO: 133 - DNA, 3033 bp, M. phaseolina
cttgagcaccgaaaagcgatgggggccaacaccagcgactcatacacatcggccgatatggccgacccgattttcagcatttatgaagccgcctgcggacggttctgacgagactgcaattcagagaacgtcgtggacaggcacttcacaatggctcctcagacggaatacgtacctcgcaactggacgaggagcagtaaggacgcggccggccatcccagcctgttcttgcagagtaacaacccgcacatcccatgtgccttctccttcgaggtgctccgtccaaacctcttccgcacgactttccaatcagaaagtcaccccttgccaccgcacccgcaggccgccatccccgcaccagatctggggtctgagaagcctgaaatcgatagttcagaaacgtccgccaagttcactcacaatggagtgaccgcaacggtggattgggcagacactcctatcgtcagccttcaattcgtcgacgcaaagacacctatccacacggatctccccttccggtcctacgccatcgacggcagcggcgtcgcgcactacacgcgctacaaccggcacacgctccacgtcgggctgggcgagaagcccgcacccatggacctgtcgaaccggcacttcgttctctccgctacggactgcttcggtaagactgcctccccattatgccctctttttcgtctgacagggtgaaatcgcaggctacgatgtgtaccgcacggacccgatgtacaaacacatcccactgctcatcaacgcgacgcccacgggcgtggtcggcgttttctcgacctcgcactcgcgggggacgtactcggtcggctccgagatggacgggctgtggggccacttcaaggtgtaccggcaggaccacggcgggctggaggagtatctgatcacggggcggaccatcagcgacgtcgtgcggacctacgcctcgctggtaggcaagccgctgcgagtgccgcgctgggccttcggttatctggctggcggcatgaaatgtgcgtcctcccgattccctccctatctctctctctcatcaccaagaaacgagactcatgactgacgggatttgaaacacagactccatgctcgacgagccgcgcgccgctgatgcgctgatggccttcgccgaccagctgcgtgcgcacgacatcccctgctccggcttccagatgtcgagcggctacacggtcgccgagacggagcccaagacgcgcaacgtcttcacctggaaccggcaccgcttcccggaccccaagggctggatcgacgcctaccacgcgcgcggcatcaagctcatcgccaacatcaagccctacgtgctgggcagccaccccaagtacgaggagctgagagccggtggcgccttcttccaagaccccataaccaaggcgtcggcggaggcgcggttgtggagtgccggcggtggcgagagcggggtgggcggccacattgacttcacgtcgaagaaggggtatgagtggtggtatgagggcgtgaaggagctgcgggagctgggcattgattgcatgtggaatgacaagtgagtgagaacttttcgtctgtgaaagaggcagaacggctaacatttgcagtaatgagtacaccattccgcatgacggatgggcttgcgcgctcgatcacccgaacgccgtcactacggcggccaaggagagggcgagcggcaggaaggacatcgggctgtggggacgggcgctccacaccgaactgatgggccggtcctcgcacgacgcggtactggcggtgcggccagatgagcggcccttcatcctgacgcgcagcgccacggcgggcagcatgcgctactgctcaagtagctggtcgggcgacaatgtgaccagttgggacggtatgaaggggtccaacgcactcagccttggcgcgggcatgtgccttctccagtgctacgggcacgatatcggcggcttcgagggccctcagccgacgccggagctgctgctgcgctgggtgcagatgggcatctactcatcgcgcttcgccatcaactgcttcaaaacttcgccggacaacaaccgcgtcggcgacgtcattgagccttggatgtacccggagatcacgccccttgtccgcgccaccatcaagcgccgctatgccctcctgccctatatctattccctccacctcgagagtcatctgcacgccaccccgccccagcgctggaccggctggggctacgagtccgacccagaagtgtggaccccggcactcaaaggtggcgagacccaattcttcctcggtgacgcgctgcttgtcggtggggtgttccagcctggcgaggagacggcgaagctatacctccccaagaaggaaggcgacgaggaagccgagttcttaaacctcaacgctccttatcagtatttgaaagcgggtcagtgggcggtgatcgagtccaagtggcaggacagcgtgcccgttctggcaaaggttggcgccgccatcccggtaggcaaggacatccaagtgttgtcgccgggcgaaaaggagaaccccgctaacctcccgccggacgactatcgtggcgtggagatcttcccagcgagagcgggaggcaagtggtttgagacaacctggctcgaggatgatggcgtcacaatctccggtaccatttcttccttcactttccggtacagtgctaccgaaaaggagattattgtcgattttgcgcctaagatcgaaggtttcaagcccgtgtggaactgtctagacgttatcttgccggtcggtgagaagaggtcggtagtgagtgaaagcggaaagcaattgaagaaagttgggcaggacaaggtgggccgcgctatattcgctctggaatccgtactgtagtatgtaaaggacatacggaccaattctcgacgaaacaaaaaaatataaaatcaaagagagctttccactacgatcggtctctcttcaacaagctctacaatttgtgattcgacttttccctcaatgattgagccacgggattgaaaagtc

SEQ ID NO: 134 - DNA, 2544 bp, M. phaseolina
atggctcctcagacggaatacgtacctcgcaactggacgaggagcagtaaggacgcggccggccatcccagcctgttcttgcagagtaacaacccgcacatcccatgtgccttctccttcgaggtgctccgtccaaacctcttccgcacgactttccaatcagaaagtcaccccttgccaccgcacccgcaggccgccatccccgcaccagatctggggtctgagaagcctgaaatcgatagttcagaaacgtccgccaagttcactcacaatggagtgaccgcaacggtggattgggcagacactcctatcgtcagccttcaattcgtcgacgcaaagacacctatccacacggatctccccttccggtcctacgccatcgacggcagcggcgtcgcgcactacacgcgctacaaccggcacacgctccacgtcgggctgggcgagaagcccgcacccatggacctgtcgaaccggcacttcgttctctccgctacggactgcttcggctacgatgtgtaccgcacggacccgatgtacaaacacatcccactgctcatcaacgcgacgcccacgggcgtggtcggcgttttctcgacctcgcactcgcgggggacgtactcggtcggctccgagatggacgggctgtggggccacttcaaggtgtaccggcaggaccacggcgggctggaggagtatctgatcacggggcggaccatcagcgacgtcgtgcggacctacgcctcgctggtaggcaagccgctgcgagtgccgcgctgggccttcggttatctggctggcggcatgaaatactccatgctcgacgagccgcgcgccgctgatgcgctgatggccttcgccgaccagctgcgtgcgcacgacatcccctgctccggcttccagatgtcgagcggctacacggtcgccgagacggagcccaagacgcgcaacgtcttcacctggaaccggcaccgcttcccggaccccaagggctggatcgacgcctaccacgcgcgcggcatcaagctcatcgccaacatcaagccctacgtgctgggcagccaccccaagtacgaggagctgagagccggtggcgccttcttccaagaccccataaccaaggcgtcggcggaggcgcggttgtggagtgccggcggtggcgagagcggggtgggcggccacattgacttcacgtcgaagaaggggtatgagtggtggtatgagggcgtgaaggagctgcgggagctgggcattgattgcatgtggaatgacaataatgagtacaccattccgcatgacggatgggcttgcgcgctcgatcacccgaacgccgtcactacggcggccaaggagagggcgagcggcaggaaggacatcgggctgtggggacgggcgctccacaccgaactgatgggccggtcctcgcacgacgcggtactggcggtgcggccagatgagcggcccttcatcctgacgcgcagcgccacggcgggcagcatgcgctactgctcaagtagctggtcgggcgacaatgtgaccagttgggacggtatgaaggggtccaacgcactcagccttggcgcgggcatgtgccttctccagtgctacgggcacgatatcggcggcttcgagggccctcagccgacgccggagctgctgctgcgctgggtgcagatgggcatctactcatcgcgcttcgccatcaactgcttcaaaacttcgccggacaacaaccgcgtcggcgacgtcattgagccttggatgtacccggagatcacgccccttgtccgcgccaccatcaagcgccgctatgccctcctgccctatatctattccctccacctcgagagtcatctgcacgccaccccgccccagcgctggaccggctggggctacgagtccgacccagaagtgtggaccccggcactcaaaggtggcgagacccaattcttcctcggtgacgcgctgcttgtcggtggggtgttccagcctggcgaggagacggcgaagctatacctccccaagaaggaaggcgacgaggaagccgagttcttaaacctcaacgctccttatcagtatttgaaagcgggtcagtgggcggtgatcgagtccaagtggcaggacagcgtgcccgttctggcaaaggttggcgccgccatcccggtaggcaaggacatccaagtgttgtcgccgggcgaaaaggagaaccccgctaacctcccgccggacgactatcgtggcgtggagatcttcccagcgagagcgggaggcaagtggtttgagacaacctggctcgaggatgatggcgtcacaatctccggtaccatttcttccttcactttccggtacagtgctaccgaaaaggagattattgtcgattttgcgcctaagatcgaaggtttcaagcccgtgtggaactgtctagacgttatcttgccggtcggtgagaagaggtcggtagtgagtgaaagcggaaagcaattgaagaaagttgggcaggacaaggtgggccgcgctatattcgctctggaatccgtactgtag

SEQ ID NO: 135 - protein, 847 aa, M. phaseolina
MAPQTEYVPRNWTRSSKDAAGHPSLFLQSNNPHIPCAFSFEVLRPNLFRTTFQSESHPLPPHPQAAIPAPDLGSEKPEIDSSETSAKFTHNGVTATVDWADTPIVSLQFVDAKTPIHTDLPFRSYAIDGSGVAHYTRYNRHTLHVGLGEKPAPMDLSNRHFVLSATDCFGYDVYRTDPMYKHIPLLINATPTGVVGVFSTSHSRGTYSVGSEMDGLWGHFKVYRQDHGGLEEYLITGRTISDVVRTYASLVGKPLRVPRWAFGYLAGGMKYSMLDEPRAADALMAFADQLRAHDIPCSGFQMSSGYTVAETEPKTRNVFTWNRHRFPDPKGWIDAYHARGIKLIANIKPYVLGSHPKYEELRAGGAFFQDPITKASAEARLWSAGGGESGVGGHIDFTSKKGYEWWYEGVKELRELGIDCMWNDNNEYTIPHDGWACALDHPNAVTTAAKERASGRKDIGLWGRALHTELMGRSSHDAVLAVRPDERPFILTRSATAGSMRYCSSSWSGDNVTSWDGMKGSNALSLGAGMCLLQCYGHDIGGFEGPQPTPELLLRWVQMGIYSSRFAINCFKTSPDNNRVGDVIEPWMYPEITPLVRATIKRRYALLPYIYSLHLESHLHATPPQRWTGWGYESDPEVWTPALKGGETQFFLGDALLVGGVFQPGEETAKLYLPKKEGDEEAEFLNLNAPYQYLKAGQWAVIESKWQDSVPVLAKVGAAIPVGKDIQVLSPGEKENPANLPPDDYRGVEIFPARAGGKWFETTWLEDDGVTISGTISSFTFRYSATEKEIIVDFAPKIEGFKPVWNCLDVILPVGEKRSVVSESGKQLKKVGQDKVGRAIFALESVL

SEQ ID NO: 136 - DNA, 1717 bp, M. phaseolina
aacgcggtgctcgaggctgcgggcgcgttgacggaggtgacgggccgccagcctgagctgccggactgggcgttcgatggcgccatcttggggattcagggtggacaggagaaggtggagcgcatcgtcagggacgcgctggcggcggatatgccgctcgtgagcgtgtggctgcaggactggagcggtaccaggctgcaggccggcgcgtataatgtgtccatcagccgcctttggtggaactgggagcccgatgctacgctctacccaacctgggcggagtgggtgccacatctaagaagtgagtacggcgtcaggacgatgagctatgtgaacacgttcctggcaaatgtcagcagcaagacgacagggtacaaccggtccttctacgcggaggctgccgcggaagggcgcttcgtgctgaatgccacggcgggagatggctcgccctggacggtgacgagcggacccggcatcgacgctggcctgctggacctctcgaacgagacgaccaggcagtggttcaaggacctgtacaaggagcagtactactccgtccccatctccggcggtaagtttgccctacccttgtttcaatcgctcaaccatttactcacttccaaccgtagccatgcaagacttcggcgaataccttgacgtcacctccgtcgtcagcatatccagcggcaccatcaacccgcgcctcttccacaacgaatacccggccgcctgggccaagctgctccgcgaagtcgtcgaagaactcggcctcgccaacgacaccatcggcttccaccgctcggcttcgaccttctcgctgccgcacaccaacctcttctgggttggcgaccagaacatcgacacctcgcgcgaagacggcatgcgggccgccatcagctccgcgctgcacgtcggcctcagcggcttcgcgcagtcgcactcggacatcggcggctacaccaacacgctcgcgccggtgggcaacatcacgcgctccgcggcgctgctggggcgctggggcgagatgggcgcgtttggcggtgccgccttcaggacgcacgaggggaacatcccccaggtgaatgcacaggcgtacacaaatgccagcaccctggcgtatcattcgtacaatgcgcgtctgttcgccgcgctgaagacgtaccggaaaagcgtggtgggcgagtatcagaggtccgggtggccgctgttgcggcatccggtcgtgtatgcgccgcgcgacgaacgtgccgtggcgaccgtggatgaggtgttctggctcggcgaggcactgctcgtcgcgcccgtatatgacgtcgaggcgcagacgctcgaggtgtatctaccgaggatcgaggtcgggagcgacgggcaggctgtcgagggggcgcagtacaagcatttgtggacgggccagctgtttgaacccggggagacggttacagtcgatgcgccgtggggtaagccgggtatttttgtcaggtggccgttgaaggatggtgaggacgaggcgttgcagggattgtgggatttcgtgaagaaggagaatgggacggctttgactgcttgagcgggatgggggaaagaaagcggactgagcgcgtggctcctccgagtggaaagaagcattgtgggagaggaattaatctggtgcgctcgataagacgggctcaaaagcaatagaaaacatctgacctcgtcggttgccacgcacacagca

SEQ ID NO: 137 - DNA, 1359 bp, M. phaseolina
atgccgctcgtgagcgtgtggctgcaggactggagcggtaccaggctgcaggccggcgcgtataatgtgtccatcagccgcctttggtggaactgggagcccgatgctacgctctacccaacctgggcggagtgggtgccacatctaagaagtgagtacggcgtcaggacgatgagctatgtgaacacgttcctggcaaatgtcagcagcaagacgacagggtacaaccggtccttctacgcggaggctgccgcggaagggcgcttcgtgctgaatgccacggcgggagatggctcgccctggacggtgacgagcggacccggcatcgacgctggcctgctggacctctcgaacgagacgaccaggcagtggttcaaggacctgtacaaggagcagtactactccgtccccatctccggcgccatgcaagacttcggcgaataccttgacgtcacctccgtcgtcagcatatccagcggcaccatcaacccgcgcctcttccacaacgaatacccggccgcctgggccaagctgctccgcgaagtcgtcgaagaactcggcctcgccaacgacaccatcggcttccaccgctcggcttcgaccttctcgctgccgcacaccaacctcttctgggttggcgaccagaacatcgacacctcgcgcgaagacggcatgcgggccgccatcagctccgcgctgcacgtcggcctcagcggcttcgcgcagtcgcactcggacatcggcggctacaccaacacgctcgcgccggtgggcaacatcacgcgctccgcggcgctgctggggcgctggggcgagatgggcgcgtttggcggtgccgccttcaggacgcacgaggggaacatcccccaggtgaatgcacaggcgtacacaaatgccagcaccctggcgtatcattcgtacaatgcgcgtctgttcgccgcgctgaagacgtaccggaaaagcgtggtgggcgagtatcagaggtccgggtggccgctgttgcggcatccggtcgtgtatgcgccgcgcgacgaacgtgccgtggcgaccgtggatgaggtgttctggctcggcgaggcactgctcgtcgcgcccgtatatgacgtcgaggcgcagacgctcgaggtgtatctaccgaggatcgaggtcgggagcgacgggcaggctgtcgagggggcgcagtacaagcatttgtggacgggccagctgtttgaacccggggagacggttacagtcgatgcgccgtggggtaagccgggtatttttgtcaggtggccgttgaaggatggtgaggacgaggcgttgcagggattgtgggatttcgtgaagaaggagaatgggacggctttgactgcttga

SEQ ID NO: 138 - protein, 452 aa, M. phaseolina
MPLVSVWLQDWSGTRLQAGAYNVSISRLWWNWEPDATLYPTWAEWVPHLRSEYGVRTMSYVNTFLANVSSKTTGYNRSFYAEAAAEGRFVLNATAGDGSPWTVTSGPGIDAGLLDLSNETTRQWFKDLYKEQYYSVPISGAMQDFGEYLDVTSVVSISSGTINPRLFHNEYPAAWAKLLREVVEELGLANDTIGFHRSASTFSLPHTNLFWVGDQNIDTSREDGMRAAISSALHVGLSGFAQSHSDIGGYTNTLAPVGNITRSAALLGRWGEMGAFGGAAFRTHEGNIPQVNAQAYTNASTLAYHSYNARLFAALKTYRKSVVGEYQRSGWPLLRHPVVYAPRDERAVATVDEVFWLGEALLVAPVYDVEAQTLEVYLPRIEVGSDGQAVEGAQYKHLWTGQLFEPGETVTVDAPWGKPGIFVRWPLKDGEDEALQGLWDFVKKENGTALTA

SEQ ID NO: 139 - DNA, 2110 bp, M. phaseolina
cgcttatccactagtctccacgcctcttccgtccttcccgctcgatatcaagttttggtcgtttgtcaacacgtataactgagcggtccaagctctgtaacatttcctcaatctcttaacttccgcgttcaggtgtatcataccaaaaccatggacaagtatatcaacaaagcaaagtctaaattccaggacaaagtccagcccttcctccaggaccgcaacaactcatcacaccaaaacagcaaccacaatagcccccctccaatacctcccaagccactcattccgctcaagtctcaacaagcggaccgaccgtcgagcatcacgccagtgacggccctcgacgtcctccgctaccgctaccaacacggcgccaacctcggctctatctacgtgctcgaaaaatggctcttcccgggtatgttccccagcaactgctcgggccacggcaagagcagcgagctcgaggccgtgcgagccaatgtcgcggagttgggcatggacggcgcgcgtgagaagttcgagcggcactgggcgggcgccgtcacggacgcagaccttgactggctggtcgggaaggccaaatgtacgtaatccatgcattaacacttttctccatccctcatctcctagcagtactactgctgacagagatgcccaaggcaacaccatccgcctccccatcggttacttcacactgggccccgccgcccacgccgacccttccgaccccttccacgctttcgcccccgtctacgcgaacgcgtggtcgtcggtgtgcgcgttggtgtcgcgcctgcacgctcgcggcatcggtacccttcttgacctgcacggcctgcccggcggcgccaacggctgcgatcactcgggcacgaacagtgggcgcgccgagcactggcggtcgccggcgtgccgcgaccggagcacgcgctgcttggcgtggatcgcggagcaggtgcgcgaggatgcagggctcagggaaggtgttgtggggttgcaggtatgcaatgaagcggagtggggcgcgaaggggctgtgggagtggtatgagggtgtggttggggcagttgcggcggcggagcccgggttgccggtgtatgtgagtgatgcatgggatttggggagggcggtggagtgggcgaggggggttaataaggttggtgttggggcgagagtgagcccggtggtggtggatacgcatttgtactggtgttttgcggatgcggataagaagaaggggcccgatgatattgtgagggaggtgaggggcaagctggggcagttggacggcaaagagggagatgtgttgaagaatggagcggtggcggtcataatcggggagtatagttgcgtgttgagtgaagagacgtggaagaagggtggggataagagcaaggatgattgggtgagggaattcgggcaggctctgagcagcaggttccaacagagggctctgggcagtcatttttggacatacaagatgcagtggatgccgggtggagaatggggattcaaggcatgcactgagaagggtgccatcacgccgcattggacgctgacgctatctgcggacgatgtgcgtcagaggctccagtccgcattggcgcaaagggatgagagatttggaaggactttcgggcagcattgcgggttctgggatcaaaattctcccgggacgcccttcgagcactggagatatgaacaaggatggaagcaaggcttcgatgacgcagcagccttttttggtatgcgggtgaatggaggcttcggagatgtcaatgccttgggcgaaggtggtcaaggtggaggtgttgggggcgataagattgggaatctggaaatctgggtgaggagaaggctgattgagagcggcatgggggggccgttcgtctgggagtacgagcagggattgaggaaaggtgtgggtgagttctgtgagcttgcgggagggctttaataatgcacgaacgcccgcaatcccaaccaatcagtgccttttcaggctagtttagctgggcttgctggttcggattatgaacgtatctagtctaccattttttgcctcttgttgacatatattcactgaataagatacaggagaaggtag

SEQ ID NO: 140 - DNA, 1734 bp, M. phaseolina
atggacaagtatatcaacaaagcaaagtctaaattccaggacaaagtccagcccttcctccaggaccgcaacaactcatcacaccaaaacagcaaccacaatagcccccctccaatacctcccaagccactcattccgctcaagtctcaacaagcggaccgaccgtcgagcatcacgccagtgacggccctcgacgtcctccgctaccgctaccaacacggcgccaacctcggctctatctacgtgctcgaaaaatggctcttcccgggtatgttccccagcaactgctcgggccacggcaagagcagcgagctcgaggccgtgcgagccaatgtcgcggagttgggcatggacggcgcgcgtgagaagttcgagcggcactgggcgggcgccgtcacggacgcagaccttgactggctggtcgggaaggccaaatgcaacaccatccgcctccccatcggttacttcacactgggccccgccgcccacgccgacccttccgaccccttccacgctttcgcccccgtctacgcgaacgcgtggtcgtcggtgtgcgcgttggtgtcgcgcctgcacgctcgcggcatcggtacccttcttgacctgcacggcctgcccggcggcgccaacggctgcgatcactcgggcacgaacagtgggcgcgccgagcactggcggtcgccggcgtgccgcgaccggagcacgcgctgcttggcgtggatcgcggagcaggtgcgcgaggatgcagggctcagggaaggtgttgtggggttgcaggtatgcaatgaagcggagtggggcgcgaaggggctgtgggagtggtatgagggtgtggttggggcagttgcggcggcggagcccgggttgccggtgtatgtgagtgatgcatgggatttggggagggcggtggagtgggcgaggggggttaataaggttggtgttggggcgagagtgagcccggtggtggtggatacgcatttgtactggtgttttgcggatgcggataagaagaaggggcccgatgatattgtgagggaggtgaggggcaagctggggcagttggacggcaaagagggagatgtgttgaagaatggagcggtggcggtcataatcggggagtatagttgcgtgttgagtgaagagacgtggaagaagggtggggataagagcaaggatgattgggtgagggaattcgggcaggctctgagcagcaggttccaacagagggctctgggcagtcatttttggacatacaagatgcagtggatgccgggtggagaatggggattcaaggcatgcactgagaagggtgccatcacgccgcattggacgctgacgctatctgcggacgatgtgcgtcagaggctccagtccgcattggcgcaaagggatgagagatttggaaggactttcgggcagcattgcgggttctgggatcaaaattctcccgggacgcccttcgagcactggagatatgaacaaggatggaagcaaggcttcgatgacgcagcagccttttttggtatgcgggtgaatggaggcttcggagatgtcaatgccttgggcgaaggtggtcaaggtggaggtgttgggggcgataagattgggaatctggaaatctgggtgaggagaaggctgattgagagcggcatgggggggccgttcgtctgggagtacgagcagggattgaggaaaggtgtgggtgagttctgtgagcttgcgggagggctttaa

SEQ ID NO: 141 - protein, 577 aa, M. phaseolina
MDKYINKAKSKFQDKVQPFLQDRNNSSHQNSNHNSPPPIPPKPLIPLKSQQADRPSSITPVTALDVLRYRYQHGANLGSIYVLEKWLFPGMFPSNCSGHGKSSELEAVRANVAELGMDGAREKFERHWAGAVTDADLDWLVGKAKCNTIRLPIGYFTLGPAAHADPSDPFHAFAPVYANAWSSVCALVSRLHARGIGTLLDLHGLPGGANGCDHSGTNSGRAEHWRSPACRDRSTRCLAWIAEQVREDAGLREGVVGLQVCNEAEWGAKGLWEWYEGVVGAVAAAEPGLPVYVSDAWDLGRAVEWARGVNKVGVGARVSPVVVDTHLYWCFADADKKKGPDDIVREVRGKLGQLDGKEGDVLKNGAVAVIIGEYSCVLSEETWKKGGDKSKDDWVREFGQALSSRFQQRALGSHFWTYKMQWMPGGEWGFKACTEKGAITPHWTLTLSADDVRQRLQSALAQRDERFGRTFGQHCGFWDQNSPGTPFEHWRYEQGWKQGFDDAAAFFGMRVNGGFGDVNALGEGGQGGGVGGDKIGNLEIWVRRRLIESGMGGPFVWEYEQGLRKGVGEFCELAGGL

SEQ ID NO: 142 - DNA, 1641 bp, M. phaseolina
tccataatcacactatataacttgcgacaatctctggcatatcttgcctatagctcaactcggctccacattccagccccacgactgagcttgctggtgtgcattaacgtcacatccctcctttgaggcatggtacactccactcccatcatgcaatacctcgcagctcttgttgccgctcttgcggccacaacgactgccgctcccgtcctggactcgaggtctttcgggacggatcttacggcactgctcaagaagatcgggatctctattcaaaccaacagcaactcccacggttctctttcaggcgctattacgttcacttttccgaaggtcagcctctctctgaagcggttcgtccatgaaatcacctggccaaaaggatgtaccgagcaggccttcatggattggtccacgttcaaggccaacggtgtcaaccttggcgcatggttagagcaagaaaggacacatgatcctgcgtggtgggactcgcacgcccctggcactattgatgagtggaacttctgcgcccaacttggcaaccggtgcggtaccgtcctcgaagaacgttatgccaccttcatcaccacttcagatatcgacaagctcgcttcagtaggcgtcaatgtgcttcgaattcccacaacctatgccgcctgggtgagggtacctggctcaaacctctacactggcaatcagcagaaacatctctccaaaatcgtaaactacgccatcgaaaagtacaacatgcatattatcatcgggttgcatagtctccctggtggtgtcaactctctggacattggcgaaggagtcggtcgctacggctggttcaacaatgcgacaaatctggactattccttccaagctgtcgacgcaatcctcgcatttatcaagggctcgggccacatcaacgccttcactgtcgcacccctgaatgaagcttccgatacgaatctcgtcgggtttgggagcgcagcaggcttgaccgccaacggaacagactggatcaacacctacgtcaagggcgtgcttctaaagattgctaaattggacaaacgtattcctttgatgcttcaggactgcttcgagggaccggattactgggcccccttttacgatgcaagtaccaatctcgttattgatagccacgtctactattttgctgccagcggtgtttacagccaatatgtggccccggccatctgcggtcaagctgccgctctccccggcaagggcaagtttccggtttttgttggtgaatgggcactgcagacggcctacaacaacacattcgacagtcgcaagaccatcttcgacactcaacgttatgcttggcagaagtatgcatctggcggcgccttctggacggccaggtcgctctcaaccactgctgttgatggagagggtatccaggaagattactggagttacatcggccttcaagaggctggcgtgatcacatcgcagacgaacagcagctattgttgatcagtcagcgggagaatatcttgatgaggatgaatcatctttttctcttgcataactggaggctctccgttccttgtatataatatgatagcgttgtaatgtctgatgtgtattttcttcatgtagaaggataaatagacaagtgcggaa

SEQ ID NO: 143 - DNA, 1341 bp, M. phaseolina
atgcaatacctcgcagctcttgttgccgctcttgcggccacaacgactgccgctcccgtcctggactcgaggtctttcgggacggatcttacggcactgctcaagaagatcgggatctctattcaaaccaacagcaactcccacggttctctttcaggcgctattacgttcacttttccgaaggtcagcctctctctgaagcggttcgtccatgaaatcacctggccaaaaggatgtaccgagcaggccttcatggattggtccacgttcaaggccaacggtgtcaaccttggcgcatggttagagcaagaaaggacacatgatcctgcgtggtgggactcgcacgcccctggcactattgatgagtggaacttctgcgcccaacttggcaaccggtgcggtaccgtcctcgaagaacgttatgccaccttcatcaccacttcagatatcgacaagctcgcttcagtaggcgtcaatgtgcttcgaattcccacaacctatgccgcctgggtgagggtacctggctcaaacctctacactggcaatcagcagaaacatctctccaaaatcgtaaactacgccatcgaaaagtacaacatgcatattatcatcgggttgcatagtctccctggtggtgtcaactctctggacattggcgaaggagtcggtcgctacggctggttcaacaatgcgacaaatctggactattccttccaagctgtcgacgcaatcctcgcatttatcaagggctcgggccacatcaacgccttcactgtcgcacccctgaatgaagcttccgatacgaatctcgtcgggtttgggagcgcagcaggcttgaccgccaacggaacagactggatcaacacctacgtcaagggcgtgcttctaaagattgctaaattggacaaacgtattcctttgatgcttcaggactgcttcgagggaccggattactgggcccccttttacgatgcaagtaccaatctcgttattgatagccacgtctactattttgctgccagcggtgtttacagccaatatgtggccccggccatctgcggtcaagctgccgctctccccggcaagggcaagtttccggtttttgttggtgaatgggcactgcagacggcctacaacaacacattcgacagtcgcaagaccatcttcgacactcaacgttatgcttggcagaagtatgcatctggcggcgccttctggacggccaggtcgctctcaaccactgctgttgatggagagggtatccaggaagattactggagttacatcggccttcaagaggctggcgtgatcacatcgcagacgaacagcagctattgttga

SEQ ID NO: 144 - protein, 446 aa, M. phaseolina
MQYLAALVAALAATTTAAPVLDSRSFGTDLTALLKKIGISIQTNSNSHGSLSGAITFTFPKVSLSLKRFVHEITWPKGCTEQAFMDWSTFKANGVNLGAWLEQERTHDPAWWDSHAPGTIDEWNFCAQLGNRCGTVLEERYATFITTSDIDKLASVGVNVLRIPTTYAAWVRVPGSNLYTGNQQKHLSKIVNYAIEKYNMHIIIGLHSLPGGVNSLDIGEGVGRYGWFNNATNLDYSFQAVDAILAFIKGSGHINAFTVAPLNEASDTNLVGFGSAAGLTANGTDWINTYVKGVLLKIAKLDKRIPLMLQDCFEGPDYWAPFYDASTNLVIDSHVYYFAASGVYSQYVAPAICGQAAALPGKGKFPVFVGEWALQTAYNNTFDSRKTIFDTQRYAWQKYASGGAFWTARSLSTTAVDGEGIQEDYWSYIGLQEAGVITSQTNSSYC

SEQ ID NO: 145 - DNA, 1657 bp, M. phaseolina
gtgggaagtgccaagctgggaagtcacaagctaccgctggcacctacttatacttgtccaaacccacctcctttacttcactctttcttctgctctgccttctacactatcacctgaaacccttccttgctactgcagacaccacggacgatgacgctcacactccttttgctggtgctcttttttgcgctggccgtcgcccaaatcgcaacgtccgatgacctcttcgaggctaagcttgcagagtctcctcttctgcgtggagtcaaccttggcggatggctcgttcttgaacccttcctcacgccggagctgttcacgaatggcgccatcgaccagtggactttcgatcagaagcccggatccgaaaatctgctccgaagccactgggacacatactgcaccgaggccgacatcaagaagctcgcatcatacggtatcagtgcgtaagtcatcgcccagcaggataggaaatgggatctctgcacttatttgcttcaagggttcgcatcggtattggtttctgggcctacgacaatgcaggcaccccataccactctggcgccgatgcttacctcagccaggccatcaaatgggcaaaggatgccggtctgctagtagccatcgagcttcatggagcacctggatctcagaatggaaatgcctgctcaggtcacgaaggaaagggggaggtatgtgtggaaaggtcccttcaagagcagcaggcgcttattattttcagtggcaaagcgacgccgtcaatctcaaccgtacgacgagcgtactcgagaccatagcgcaaaaatacggtacgaaggaactcgccagcacagtcatatccattgagctggtgaatgagcccacaaacacaccaccaaacaccctcgaagttacaaaggcttggacgaaggctacctacgaggttgtgcgtgcggctgcaagcaacaaggacttgcgcatcgtcatgcatgaccagtgggtcactccgaagaattggctcgacatcaatgaggcattgaacggtccgaaccccgactccttcgttctggatgtccatcattatcagatattcacccaaggagatcggcacctcgaccagcctggccacatccagaaagtctgccagttcgccagcgagcagctcgcgctggccaagcaaacccaactgccgatccaggtcggtgagttcagcggcaacacgttcatctgcgtcaacccggacggcagcaccttcgcagatcctgctggcactggcaaggtctgcaaggtcgagggttgccaatgcgagacggatggagggattgcggtggacaaatggggggatgcgatcactcaacaggtccggcggtatgtggaggcgcaactgtatgtgtttgagcagtacgctggaggatggttcttctggaatttcaaggggccgggctcctgggggttcatgaccggcgtggagaaggggttcattcctcaaccactctctgataggcgctaccccaatccgtgtctgtagccctatcgtaacagccgcgtcagcaagcacatttatctccgttgagggctctctcgctatggcattttgatagagttgctgcgaaacatatcctctagtcaatgcattctgaggagcatcagcggtaacggacaagaacatagcaatgtc

SEQ ID NO: 146 - DNA, 1251 bp, M. phaseolina
atgacgctcacactccttttgctggtgctcttttttgcgctggccgtcgcccaaatcgcaacgtccgatgacctcttcgaggctaagcttgcagagtctcctcttctgcgtggagtcaaccttggcggatggctcgttcttgaacccttcctcacgccggagctgttcacgaatggcgccatcgaccagtggactttcgatcagaagcccggatccgaaaatctgctccgaagccactgggacacatactgcaccgaggccgacatcaagaagctcgcatcatacggtatcagtgcggttcgcatcggtattggtttctgggcctacgacaatgcaggcaccccataccactctggcgccgatgcttacctcagccaggccatcaaatgggcaaaggatgccggtctgctagtagccatcgagcttcatggagcacctggatctcagaatggaaatgcctgctcaggtcacgaaggaaagggggagtggcaaagcgacgccgtcaatctcaaccgtacgacgagcgtactcgagaccatagcgcaaaaatacggtacgaaggaactcgccagcacagtcatatccattgagctggtgaatgagcccacaaacacaccaccaaacaccctcgaagttacaaaggcttggacgaaggctacctacgaggttgtgcgtgcggctgcaagcaacaaggacttgcgcatcgtcatgcatgaccagtgggtcactccgaagaattggctcgacatcaatgaggcattgaacggtccgaaccccgactccttcgttctggatgtccatcattatcagatattcacccaaggagatcggcacctcgaccagcctggccacatccagaaagtctgccagttcgccagcgagcagctcgcgctggccaagcaaacccaactgccgatccaggtcggtgagttcagcggcaacacgttcatctgcgtcaacccggacggcagcaccttcgcagatcctgctggcactggcaaggtctgcaaggtcgagggttgccaatgcgagacggatggagggattgcggtggacaaatggggggatgcgatcactcaacaggtccggcggtatgtggaggcgcaactgtatgtgtttgagcagtacgctggaggatggttcttctggaatttcaaggggccgggctcctgggggttcatgaccggcgtggagaaggggttcattcctcaaccactctctgataggcgctaccccaatccgtgtctgtag

SEQ ID NO: 147 - protein, 416 aa, M. phaseolina
MTLTLLLLVLFFALAVAQIATSDDLFEAKLAESPLLRGVNLGGWLVLEPFLTPELFTNGAIDQWTFDQKPGSENLLRSHWDTYCTEADIKKLASYGISAVRIGIGFWAYDNAGTPYHSGADAYLSQAIKWAKDAGLLVAIELHGAPGSQNGNACSGHEGKGEWQSDAVNLNRTTSVLETIAQKYGTKELASTVISIELVNEPTNTPPNTLEVTKAWTKATYEVVRAAASNKDLRIVMHDQWVTPKNWLDINEALNGPNPDSFVLDVHHYQIFTQGDRHLDQPGHIQKVCQFASEQLALAKQTQLPIQVGEFSGNTFICVNPDGSTFADPAGTGKVCKVEGCQCETDGGIAVDKWGDAITQQVRRYVEAQLYVFEQYAGGWFFWNFKGPGSWGFMTGVEKGFIPQPLSDRRYPNPCL

SEQ ID NO: 148 - DNA, 1185 bp, M. phaseolina
tttattaattcttaaggccgcacaactccctcccgctttttcttccccatcctccaacggtcctcactctctctacacggtccattcttaccgtagtccttcgttattgtaccaatccaaaacaaccgttaatatcttaattcctccaccatgaagttcacctccgccgccgtcctccttgctggctccgcccccatggccagcgccctccgcaagggctttaacattggagccactaacgccgacggctcctgcaagacccaggcgcaatgggcccaggacttcaagggcatgaagaacctgcccggcaacttcaaggacgtccgtgtctacgccgccagcgactgcaacaccctcgacctggctgtccccgccgccaaggatgctggcattcagctccttgttggcatttggaccgaggatgacgcccactacagcgcggagaaggctgctctcgaggccgccatcaccaagtacggtgtcgactggatctcggccgtctccgtcggcagcgaggatctctaccgcggcgacaccacctcgtggcgcctggccgagcaggtctatgacgtgcgcggcatgatctctcaggacaagtacggcggcaagggcatttgggtcggccacgtcgatacgtacaacgccttcaacgcctcgtcggccgacctcatccaggcggtcgacttcctcggcgtcgacgcgtacccgtactggcagggcgtgacgcccgaccaggcccaggccaccttccagaaggccattgatgagacgcagaacttcatcaaccagtacaacccggccgctaagctgtggatcactgagaccggctggcccaccgccggccccaacttcggcaatagcgtcgcgaacaaggagaacgctaagaccttctgggatgccgtcctgtgcaagtacgcctcccagtactccatctggtggtacaccctccacgacacctccaccgaggctcaggacttcggcgtcgtcgacgacaacttcggcgctctcttcgacctcaactgccccagctcttaaacgagctgtttcgggaaggcggaacgagatgggaaaatgtgggaaatgcatggcgctatgtctcctgggtattcaagcaacgtcttagagaagagaagaggaatagagatgtggatgagatgaattagaagagaatctaaacagtcagtg

SEQ ID NO: 149 - DNA, 886 bp, M. phaseolina
atgaagttcacctccgccgccgtcctccttgctggctccgcccccatggccagcgccctccgcaagggctttaacattggagccactaacgccgacggctcctgcaagacccaggcgcaatgggcccaggacttcaagggcatgaagaacctgcccggcaacttcaaggacgtccgtgtctacgccgccagcgactgcaacaccctcgacctggctgtccccgccgccaaggatgctggcattcagctccttgttggcatttggaccgaggatgacgcccactacagcgcggagaaggctgctctcgaggccgccatcaccaagtacggtgtcgactggatctcggccgtctccgtcggcagcgaggatctctaccgcggcgacaccacctcgtggcgcctggccgagcaggtctatgacgtgcgcggcatgatctctcaggacaagtacggcggcaagggcatttgggtcggccacgtcgatacgtacaacgccttcaacgcctcgtcggccgacctcatccaggcggtcgacttcctcggcgtcgacgcgtacccgtactggcagggcgtgacgcccgaccaggcccaggccaccttccagaaggccattgatgagacgcagaacttcatcaaccagtacaacccggccgctaagctgtggatcactgagaccggctggcccaccgccggccccaacttcggcaatagcgtcgcgaacaaggagaacgctaagaccttctgggatgccgtcctgtgcaagtacgcctcccagtactccatctggtggtacaccctccacgacacctccaccgaggctcaggacttcggcgtcgtcgacgacaacttcggcgctctcttcgacctcaactgccccagctcttaaa

SEQ ID NO: 150 - protein, 294 aa, M. phaseolina
MKFTSAAVLLAGSAPMASALRKGFNIGATNADGSCKTQAQWAQDFKGMKNLPGNFKDVRVYAASDCNTLDLAVPAAKDAGIQLLVGIWTEDDAHYSAEKAALEAAITKYGVDWISAVSVGSEDLYRGDTTSWRLAEQVYDVRGMISQDKYGGKGIWVGHVDTYNAFNASSADLIQAVDFLGVDAYPYWQGVTPDQAQATFQKAIDETQNFINQYNPAAKLWITETGWPTAGPNFGNSVANKENAKTFWDAVLCKYASQYSIWWYTLHDTSTEAQDFGVVDDNFGALFDLNCPSS

SEQ ID NO: 151 - DNA, 1373 bp, M. phaseolina
cacgtcgctctttctggccgaagcttcgcactccgagtgcgcgccattcctttcgagactgccacttattagctgcaccgtccccgctgcccgtcgttcccgcgtcttcctccacctccaaagatacctggtcgccgcaaccactccaacatgcgcctttccaccctccttcccgccgccgctctggccatcgcccccgccgccgcctcgggcactctgggcttctcgctgggtaccaagctcgccgacggcagctgcaagtaccaggccgactacgagaaggacttcgacgccatttccaaggccaccggcagcaagctggtccgcggctactcggcctcggactgcaactgcgccaaggagatcctgcccgccgcgaaggccaagggcttccaggtcgtcctcgccgtgtggtgcgtgcgcccccgtctctcggtttaagcatgccgtataaggttgtttccaggtggagcccatgacgctgacgcgcaagcactttcgtcccgcaacaggcccgatgtcgacgagtctctcgaggccgacaagaaggccctcaagacctacgctaccgacgagtacgccgaccagatctacgccgtgaccgtcggctccgagacgctctaccgcggcaatttcaccggcgaggagctgctcgacaagatcaacgacgtgcgcaccgtcctgcccaagggctgcaaggtcggcaccgccgactcgtggaacaagtgggccgacggcactggtgacgcggtcgtcaagggcggcgtcgacctcatcctcgccaacgccttcgcctactggcagggccaggacatcaagaacgcctctgccacctacttcgaggatatggctcgcgccattgagcacatccaggacgttgctggcggccccgagaaggctcccgaaatctggaacggcgagactggctggcccaccgatggtacgtagtatgcatctccgtttcgaaatgcatgtgtgttaactccaaaccaggcggctctgactacgaggacgccaaggccggcacggacattgctaagacctactaccacgaggccgtctgcggtgcgctcaagtggggcgtcaacgctttctactttgaggccttcgacgagccttggaagcctcacgccatcggtgactctggtgccgccggtgacgagaccaagtggggagccatgaccgctgatcgccaggtcaagttcgacctcaagtgcaaatagacgagctgtgttcgtgtggatgagattccactaattcacttagtctttttttgtgtcttgcattgggctgcgaggttttacttctgctaggcgaactattattacctgatatcctatggctgtttggggaaaggaattgatggagagatt

SEQ ID NO: 152 - DNA, 921 bp, M. phaseolina
atgcgcctttccaccctccttcccgccgccgctctggccatcgcccccgccgccgcctcgggcactctgggcttctcgctgggtaccaagctcgccgacggcagctgcaagtaccaggccgactacgagaaggacttcgacgccatttccaaggccaccggcagcaagctggtccgcggctactcggcctcggactgcaactgcgccaaggagatcctgcccgccgcgaaggccaagggcttccaggtcgtcctcgccgtgtggcccgatgtcgacgagtctctcgaggccgacaagaaggccctcaagacctacgctaccgacgagtacgccgaccagatctacgccgtgaccgtcggctccgagacgctctaccgcggcaatttcaccggcgaggagctgctcgacaagatcaacgacgtgcgcaccgtcctgcccaagggctgcaaggtcggcaccgccgactcgtggaacaagtgggccgacggcactggtgacgcggtcgtcaagggcggcgtcgacctcatcctcgccaacgccttcgcctactggcagggccaggacatcaagaacgcctctgccacctacttcgaggatatggctcgcgccattgagcacatccaggacgttgctggcggccccgagaaggctcccgaaatctggaacggcgagactggctggcccaccgatggcggctctgactacgaggacgccaaggccggcacggacattgctaagacctactaccacgaggccgtctgcggtgcgctcaagtggggcgtcaacgctttctactttgaggccttcgacgagccttggaagcctcacgccatcggtgactctggtgccgccggtgacgagaccaagtggggagccatgaccgctgatcgccaggtcaagttcgacctcaagtgcaaatag

SEQ ID NO: 153 - protein, 306 aa, M. phaseolina
MRLSTLLPAAALAIAPAAASGTLGFSLGTKLADGSCKYQADYEKDFDAISKATGSKLVRGYSASDCNCAKEILPAAKAKGFQVVLAVWPDVDESLEADKKALKTYATDEYADQIYAVTVGSETLYRGNFTGEELLDKINDVRTVLPKGCKVGTADSWNKWADGTGDAVVKGGVDLILANAFAYWQGQDIKNASATYFEDMARAIEHIQDVAGGPEKAPEIWNGETGWPTDGGSDYEDAKAGTDIAKTYYHEAVCGALKWGVNAFYFEAFDEPWKPHAIGDSGAAGDETKWGAMTADRQVKFDLKCK

SEQ ID NO: 154 - DNA, 1758 bp, M. phaseolina
agaattcaggcttaaatccgcctgccggctttttcttgtttacaattcctccaactgcagtctccctcccgttcttgcccccagcgcattctgaggcattgagcgtccgtaggtcgtatctccttcgcgcgctcgcattcctggttcgtcatgttgtcacgatacttcgcttccgcgttgctggctacgaccgtcgtttttggcgcagctatgtatgctccctctgccctcgagccgccgcagtcagcacattgactttttacctcagcgagaagagaaaggtctccttcaattggggcggggaaaaggtctgcggcctcaacattgggggatggctcgtcctggaaccgtaagttcgcccaacaaaaccaatctcgtgacacaatctcttcggcctccttcagattcaaccttcagcaaactgagctcggaaattaatttgttttggcttcagatggatcactccctccatcttcgagcagtttgacgcgtctcagggcatcattgacgagttcacactgaacgagaagcttggcagagacaaggctttggaggttctgaaaccgcattgggacagctgggtcgggttcgaggatttccagcgcattgccgacgccggctttaatctcgtcaggatcccagtcggcttctgggcctatgacacgttcggctcggcctactctcagggagctgcgccgtacatcgatgccgccattgactgggccaggggcacaggcctgaaggtcctgattgatcttcacggcgcgccgggatctcagaacggatacgacaattccgggcagaggatggaaaccccgcaatggctgcagggtgacaccgtcaaccagacgctctccgtcatccagcagattgcggacaagtacgcaaaaaccgaataccaggacgtcatcgccggcatccagctgttaaacgaaccggccggttacgagttggacgtcaacgcgatcaagcagttcgaccgtgacggatatgcgaaggtcaggagtgtcagtgacaccacggtcgtcatccatgatgctttccagaacccgagctcgtacaatggctggatgacaccatcggacaacaatgttcagaatgtcgttcttgaccatcacgagtaccaagttttcgacaatggcatgatcaagtggtccgccgctgaacaccggcagggtgtgtgcaacaatagagctcgttgggagggctccgacaagtggactatcgtgggcgaatggactggtgctatgactgattgcgcgaaatggctaaacggtatgcccaccctcctttgacaacctttcccagtgtaagctaacacatactccaggctacggacgtggtgctcgttatgataacaccttcgagggcgccggctacgtcggtgactgtggcttcgccagcgaccttgactcctgggatcagcagcgcaaggacgacacgcgctggtacatcgagacgcagctgtctgcattcgagaagatcgatggttggatcttctggaacttcaagaccgagcaggcgcccgagtgggattggggcaagctctccgccgcaggtgtcttcccaaacccggtcacggacaggaagttctccgcagtctgctaattgtggaggatatcatgaggggttctgtctgggctggttggtgaagcaatccattgttcgagagggcatggactgggaatggaacgacacacatccaaggtgcaacttgtgattttctaataggttgggcttagcaagtttcccacaccg

SEQ ID NO: 155 - DNA, 1242 bp, M. phaseolina
atgttgtcacgatacttcgcttccgcgttgctggctacgaccgtcgtttttggcgcagctatcgagaagagaaaggtctccttcaattggggcggggaaaaggtctgcggcctcaacattgggggatggctcgtcctggaaccatggatcactccctccatcttcgagcagtttgacgcgtctcagggcatcattgacgagttcacactgaacgagaagcttggcagagacaaggctttggaggttctgaaaccgcattgggacagctgggtcgggttcgaggatttccagcgcattgccgacgccggctttaatctcgtcaggatcccagtcggcttctgggcctatgacacgttcggctcggcctactctcagggagctgcgccgtacatcgatgccgccattgactgggccaggggcacaggcctgaaggtcctgattgatcttcacggcgcgccgggatctcagaacggatacgacaattccgggcagaggatggaaaccccgcaatggctgcagggtgacaccgtcaaccagacgctctccgtcatccagcagattgcggacaagtacgcaaaaaccgaataccaggacgtcatcgccggcatccagctgttaaacgaaccggccggttacgagttggacgtcaacgcgatcaagcagttcgaccgtgacggatatgcgaaggtcaggagtgtcagtgacaccacggtcgtcatccatgatgctttccagaacccgagctcgtacaatggctggatgacaccatcggacaacaatgttcagaatgtcgttcttgaccatcacgagtaccaagttttcgacaatggcatgatcaagtggtccgccgctgaacaccggcagggtgtgtgcaacaatagagctcgttgggagggctccgacaagtggactatcgtgggcgaatggactggtgctatgactgattgcgcgaaatggctaaacggctacggacgtggtgctcgttatgataacaccttcgagggcgccggctacgtcggtgactgtggcttcgccagcgaccttgactcctgggatcagcagcgcaaggacgacacgcgctggtacatcgagacgcagctgtctgcattcgagaagatcgatggttggatcttctggaacttcaagaccgagcaggcgcccgagtgggattggggcaagctctccgccgcaggtgtcttcccaaacccggtcacggacaggaagttctccgcagtctgctaa

SEQ ID NO: 156 - protein, 413 aa, M. phaseolina
MLSRYFASALLATTVVFGAAIEKRKVSFNWGGEKVCGLNIGGWLVLEPWITPSIFEQFDASQGIIDEFTLNEKLGRDKALEVLKPHWDSWVGFEDFQRIADAGFNLVRIPVGFWAYDTFGSAYSQGAAPYIDAAIDWARGTGLKVLIDLHGAPGSQNGYDNSGQRMETPQWLQGDTVNQTLSVIQQIADKYAKTEYQDVIAGIQLLNEPAGYELDVNAIKQFDRDGYAKVRSVSDTTVVIHDAFQNPSSYNGWMTPSDNNVQNVVLDHHEYQVFDNGMIKWSAAEHRQGVCNNRARWEGSDKWTIVGEWTGAMTDCAKWLNGYGRGARYDNTFEGAGYVGDCGFASDLDSWDQQRKDDTRWYIETQLSAFEKIDGWIFWNFKTEQAPEWDWGKLSAAGVFPNPVTDRKFSAVC

SEQ ID NO: 157 - DNA, 3057 bp, M. phaseolina
tatttcttcattcattcccttttgcgcgtccttttctccgcattccacgcatcatcaccaatctcgcacgaccgtctcagccacgcggaaaaaaaaaaagcctgcccacattcctgaacggcaacactactctcgcgactcagtcgagccatgccccgcgaccacgactcgccccggcgcgaccgcgaccgcaactactcccgtgaccgccatcccgccagcggcggcgaaggctaccgctccgaccgcgaacgccgccgccgccgtcgcgagagccgcgacccagccgacgacacccctccccgccgcgagcagcgtgccccccgccgccacacgcgcgacccggccagcgaccgcgagtacgacacggacgcggcgcggcagcagcagcagcagcaagagcggcgccgccgccgcgggcaccgcgccaccgactcgacgggcgagcccatcctgcggcagccggagcgctcgtacgactcgccgtaccacagcgggtcgcccagcccgaggaaaaagcacgccgcggcgcatcgtgggcggagggagagagggagctatggaggcggcggcgacagttcgcggtggacgggcacggacacgccggcgagtagagactctgggtcgagcgggcggccgctgctgcatgcagatgcgctggcgcagttggatgtaatgaactcgaagagcgggtggaaggcgaacgcgtacgacgaggcgtatctgaagcgcgtgagggagcaggaggcggcaatggagaaggagcggcagagggagcagaggagggagaggaggcgggagaaggaagcgagggcgatggagagggaaaagaggaggaggcatgaggaggagatgggatttaggcggagtcggaatgtggatgtagagttggaggatgatgaggatgagggggaggcgcagcgcctgaagcctgcgtatcctcctgttgctgatgacgggattagggtgaggggctatgatgacgagtatccggagccctacacggatgacccgtatacagatgaccctgcggagccgatacggagacggagggaatacacggaggaggagagggaggagaggcggcggagaagaaaggagagagcgcttgcggcaactgcggttgcaggaaggaacaagaaaagccgcgtcgtgagtggacctctactggaagagggcggcaaggaggattacgagtaccgtctcgcacagcgccgcggcggtggcggtggtagcagcgatgtttattacgacgaagagctgaagaagaaaaagcgaaagaagatcttcatcatcgtcggaatcatcgtgctcattctcgccattgtaatccctgtcgctgttgtagtatcagggaaaaacaagggcagcgatggggatactgctgccgccacttcgtcggactcgagtaaaccggacaacagcaatttgagcggcatatccgaagacgatatcccggagtatgcacgaggcggcctcctggaccccttcacttggtacgatacagaagacttcaacgtcaccttcaccaacgacacggtcggcggtctctcgattatgggcctcaattcgacatgggatgacagtgtccaggccaacgaacatgtcccggctctgaacaaagagttcaagtacggtgaaatgcctatccggggtgttaatgtgggcggctggctcaacattgaaccgtggattacgccctctttctttgagtcctacaatacccgcgacggtgtcatcgacgaatggacgcttacgactagtatggggggaaaggccaaagcaaatctagaagaacactactcgtcatggatcactaagcagacctgggtggacattcgaaacgcgggcttcgaccacgtccgtattccgtttaactactgggctgtcaccacgtatgacggagacccatacgttgccaaggtctcctggcggtaccttctacgcggcattgagtatgccaggcagaatggcctccgaatcaagttagatttgcacggcttgcctggtagtcaaaatggctggaaccacagcggaagacaaggcgccatcggatggttaaacggcacggacggtacgctaaacgcgcagcgcagcattgaaatccatgatcagctgtcacagttcttcgctcagccacgctataagaacgttgttacgttgtacggcctggtgaatgaaccccgcatggtggagctcaacacgaacgacgtcctttcttggtacgacgaggtcattccgaagattcgccagaacaacatcacggccattcttgtctttggcgatggtttccttggcctggacaactggcagggtaagctgcagaattacaaagacctcctgcttgacgtgcaccagtacgtcatcttcaacgtcgatctgatcaaattctcgcacgcggagaaggtcaactttgcctgcaaaggctggactcaacagtcgctgcggtccatgaacacggagaccggcttcggtccaactatgtgcggagagtggtctcaagccgacacggattgtacccagtacctcaacaatgtcggctggggtacccgttgggagggcacctacaatacaggcaacagtagcacttccgtcctcgagcccacttgtcccacagacaacaaccccgtctgctcctgcgaaaacgccaacgccgatccgtcaaactacagcgacacgtacaagaagtttttgctgcacttcgcgctcgcccagatgtacagcttcgagcaaggctggggttggttctactggacgtggaagacggagaaggcggttcagtggagttgggagagcgggatgaaggcgggcattctgcccgagaaggcgtgggatcgcagtgcatttcaatgcaatacgactgatatcccggactattctggagaaggattgccggagaactactgagaggtcaacctcctcatcttatgtgtaacgtcctttgagcctttgcattccggttttcgatttttttttttcttggttagatgtatctggtgcttgttgtttgatggcatcaaagcgcatgagcgacaggatttcattgcatgatagact

SEQ ID NO: 158 - DNA, 2757 bp, M. phaseolina
atgccccgcgaccacgactcgccccggcgcgaccgcgaccgcaactactcccgtgaccgccatcccgccagcggcggcgaaggctaccgctccgaccgcgaacgccgccgccgccgtcgcgagagccgcgacccagccgacgacacccctccccgccgcgagcagcgtgccccccgccgccacacgcgcgacccggccagcgaccgcgagtacgacacggacgcggcgcggcagcagcagcagcagcaagagcggcgccgccgccgcgggcaccgcgccaccgactcgacgggcgagcccatcctgcggcagccggagcgctcgtacgactcgccgtaccacagcgggtcgcccagcccgaggaaaaagcacgccgcggcgcatcgtgggcggagggagagagggagctatggaggcggcggcgacagttcgcggtggacgggcacggacacgccggcgagtagagactctgggtcgagcgggcggccgctgctgcatgcagatgcgctggcgcagttggatgtaatgaactcgaagagcgggtggaaggcgaacgcgtacgacgaggcgtatctgaagcgcgtgagggagcaggaggcggcaatggagaaggagcggcagagggagcagaggagggagaggaggcgggagaaggaagcgagggcgatggagagggaaaagaggaggaggcatgaggaggagatgggatttaggcggagtcggaatgtggatgtagagttggaggatgatgaggatgagggggaggcgcagcgcctgaagcctgcgtatcctcctgttgctgatgacgggattagggtgaggggctatgatgacgagtatccggagccctacacggatgacccgtatacagatgaccctgcggagccgatacggagacggagggaatacacggaggaggagagggaggagaggcggcggagaagaaaggagagagcgcttgcggcaactgcggttgcaggaaggaacaagaaaagccgcgtcgtgagtggacctctactggaagagggcggcaaggaggattacgagtaccgtctcgcacagcgccgcggcggtggcggtggtagcagcgatgtttattacgacgaagagctgaagaagaaaaagcgaaagaagatcttcatcatcgtcggaatcatcgtgctcattctcgccattgtaatccctgtcgctgttgtagtatcagggaaaaacaagggcagcgatggggatactgctgccgccacttcgtcggactcgagtaaaccggacaacagcaatttgagcggcatatccgaagacgatatcccggagtatgcacgaggcggcctcctggaccccttcacttggtacgatacagaagacttcaacgtcaccttcaccaacgacacggtcggcggtctctcgattatgggcctcaattcgacatgggatgacagtgtccaggccaacgaacatgtcccggctctgaacaaagagttcaagtacggtgaaatgcctatccggggtgttaatgtgggcggctggctcaacattgaaccgtggattacgccctctttctttgagtcctacaatacccgcgacggtgtcatcgacgaatggacgcttacgactagtatggggggaaaggccaaagcaaatctagaagaacactactcgtcatggatcactaagcagacctgggtggacattcgaaacgcgggcttcgaccacgtccgtattccgtttaactactgggctgtcaccacgtatgacggagacccatacgttgccaaggtctcctggcggtaccttctacgcggcattgagtatgccaggcagaatggcctccgaatcaagttagatttgcacggcttgcctggtagtcaaaatggctggaaccacagcggaagacaaggcgccatcggatggttaaacggcacggacggtacgctaaacgcgcagcgcagcattgaaatccatgatcagctgtcacagttcttcgctcagccacgctataagaacgttgttacgttgtacggcctggtgaatgaaccccgcatggtggagctcaacacgaacgacgtcctttcttggtacgacgaggtcattccgaagattcgccagaacaacatcacggccattcttgtctttggcgatggtttccttggcctggacaactggcagggtaagctgcagaattacaaagacctcctgcttgacgtgcaccagtacgtcatcttcaacgtcgatctgatcaaattctcgcacgcggagaaggtcaactttgcctgcaaaggctggactcaacagtcgctgcggtccatgaacacggagaccggcttcggtccaactatgtgcggagagtggtctcaagccgacacggattgtacccagtacctcaacaatgtcggctggggtacccgttgggagggcacctacaatacaggcaacagtagcacttccgtcctcgagcccacttgtcccacagacaacaaccccgtctgctcctgcgaaaacgccaacgccgatccgtcaaactacagcgacacgtacaagaagtttttgctgcacttcgcgctcgcccagatgtacagcttcgagcaaggctggggttggttctactggacgtggaagacggagaaggcggttcagtggagttgggagagcgggatgaaggcgggcattctgcccgagaaggcgtgggatcgcagtgcatttcaatgcaatacgactgatatcccggactattctggagaaggattgccggagaactactga

SEQ ID NO: 159 - protein, 918 aa, M. phaseolina
MPRDHDSPRRDRDRNYSRDRHPASGGEGYRSDRERRRRRRESRDPADDTPPRREQRAPRRHTRDPASDREYDTDAARQQQQQQERRRRRGHRATDSTGEPILRQPERSYDSPYHSGSPSPRKKHAAAHRGRRERGSYGGGGDSSRWTGTDTPASRDSGSSGRPLLHADALAQLDVMNSKSGWKANAYDEAYLKRVREQEAAMEKERQREQRRERRREKEARAMEREKRRRHEEEMGFRRSRNVDVELEDDEDEGEAQRLKPAYPPVADDGIRVRGYDDEYPEPYTDDPYTDDPAEPIRRRREYTEEEREERRRRRKERALAATAVAGRNKKSRVVSGPLLEEGGKEDYEYRLAQRRGGGGGSSDVYYDEELKKKKRKKIFIIVGIIVLILAIVIPVAVVVSGKNKGSDGDTAAATSSDSSKPDNSNLSGISEDDIPEYARGGLLDPFTWYDTEDFNVTFTNDTVGGLSIMGLNSTWDDSVQANEHVPALNKEFKYGEMPIRGVNVGGWLNIEPWITPSFFESYNTRDGVIDEWTLTTSMGGKAKANLEEHYSSWITKQTWVDIRNAGFDHVRIPFNYWAVTTYDGDPYVAKVSWRYLLRGIEYARQNGLRIKLDLHGLPGSQNGWNHSGRQGAIGWLNGTDGTLNAQRSIEIHDQLSQFFAQPRYKNVVTLYGLVNEPRMVELNTNDVLSWYDEVIPKIRQNNITAILVFGDGFLGLDNWQGKLQNYKDLLLDVHQYVIFNVDLIKFSHAEKVNFACKGWTQQSLRSMNTETGFGPTMCGEWSQADTDCTQYLNNVGWGTRWEGTYNTGNSSTSVLEPTCPTDNNPVCSCENANADPSNYSDTYKKFLLHFALAQMYSFEQGWGWFYWTWKTEKAVQWSWESGMKAGILPEKAWDRSAFQCNTTDIPDYSGEGLPENY

SEQ ID NO: 160 - DNA, 2978 bp, M. phaseolina
cctataacaagtgtttcggtgctgggtgcttatcacgttttatgtctctacttcgatactggatatacccgaagccctgaataaaaagctaattgccttttctcctgcgtcaagtccccgtcctagaccctctcccgcccagcagctacgatggccccctcgaaatttctatcgagctcccaatctcgccagtggttcagtctcctccggctggcccagacccggaaacttatgggtacacttctcaaacataccagcgatatccgcaggtacttggctatccctggccgcaatgcgctccttatagtttcaatgctccctccggcggctcgtgccgcagcaactacacctttgttcagcctcgtccaaagaagcccacggcactcgagtgtaccgacatttttgccccgctccaacacgatgacatacccgctcagatagaacccgccggaaaccacccagtgcctcgcaagggcatcgtcgaccccgtgacgaaacctacgcagaccaacaaattccacgggaacctgtacctggacacacgtaaccagacggcttggacccacccatactccgtcgcgtgggcgcaaggctctggcaaggccgggagctggggtcttgccgtgtcccatatcgaccgggacttactagtcttcggcaacgataccgctcaggactctaagactttctttgctgcgccaatcggaatccagtcgctgatcatttcggctgaagaactgggcaatggaaccgccatgacacttgataatctcgaggcctcttccgtcaacgttaacctcgcaccaggtgcgggaaggccacccgtcatcacatacccgctcgtccagggtatggggttcgtgactgggatattcaagggagcgagacctaagatccaaagcagcgtgctgttccgcaaagtaaagggaccgatcgccgtcgggggggtcttcaaataccaggtcactctccgagatggaaagaactggcttatctacgcaaaaccggaccctggctacggcattcccgtcttcaagctggtagacgccacgactctaagagggccaagaggctggcgcggcatcatcagcgtcgccaagaatcccgcgagttccggggctgaagagacgtatgacaaggccgccggcgcttacccgaccgcgatggcaatcaagggctctgtcgacgggacgaccgggaaatacgaattcaacttcgtgaaggctggcgacagctccagaccgttgcttatgttcgcgcttccccatcacgtggagagttttgatgtcgagaccctcagcacccgtacgtccatagagatgtacactaccaccaaaggccttgcaaaggggttcttgagcgacaagtggactatggtagaagagaacctgtcggtaagcatggggttcgcgccgtggaccccagaccggggcagcatcgaaaccctgtcgcgcgaagccgcctgcgtcgtcaacaatgcagcagtccgtgagctccaggaggatatagtgggccagacaaacctcgattcgatgtatttcagcggcaaagccttcgccaagttcgccgccgttatttacgctgtgcacgatttggcagggaacccacaattagcacgtgaaggtctggttaggctgaagaagtcgctggccccgttcattcaaaatactcagcaaaatccgcttgtgtacgacacgacgtggagaggcgtagtgtccactgcgggcttctcggaaccattggcggactttggcagcacctactacaacgaccaccattttcactacggatatttgtaagttccgttccctaacgctctcctgagtccatgtttcccgtgacggcgcaaagctaaaacgcactacgtagcgtctacaccgcggcagtgatcgcgtatttagacccgtcctggctctcggaagggaccaacaaggcttggatagacatgcttgtcagagactatgccaacccggtcgatgacggtgattttcccttcagccgcgcatttgactggttccagtaagtacaaaattgttcgtttgataacatagtcattggggtttaacattttcctagtggccacagttgggcaaaaggagtcttctcctcaattgacggaaaagaccaagagtcgacatctgaggtacgctgaaccttatacagagtgacgatgtacgttttactgactatatttgcgcaactgtcaggactcgttcgcaacttactccatgaaaatgtggggccgagtaacgggtgacgtcgctttggaggcgagaggtatgactcattttatgtctactaccgggtaacgtagagatgctgacgggcactttaagcaacgcttatgctaagcatacaggctcggagcttccagaactatttcctaatggaagaagacaacgctaaccagccgcgagagatgatcaataacaaagtgactggcatcttatgggagaatcgagtggcctggactacttacttcggagatttttggttttataagcaggggtaggtccttatttcccctatgcgaaggcctcgtgactgactatgtgcacagcatccacatgatccccgtccatgtgccgtcaactctgatccgcacaaagcaatttgtgcaagaggaatatgacatattcttaagcaatggcgccattgatactgcccaagagggttggaggggtattctctatgccaacctcgctcttatcgatgcggacacttcatacgacttcttttcggacccttccttcaacaccacttacttagatgggggcgctagccggacctggtatttggcttatgtgtctgccctaaggggtcattgagggtggacactaaatcttaagagcgttatccctatgcgcttgcttttccttttacatcgcagcccttctaccgcatcctctttcctctctctttctttttttagtttctacaaatattatagatatttaacaatttcctgaatgtttcta

SEQ ID NO: 161 - DNA, 2334 bp, M. phaseolina
atggccccctcgaaatttctatcgagctcccaatctcgccagtggttcagtctcctccggctggcccagacccggaaacttatgggtacacttctcaaacataccagcgatatccgcagtttcaatgctccctccggcggctcgtgccgcagcaactacacctttgttcagcctcgtccaaagaagcccacggcactcgagtgtaccgacatttttgccccgctccaacacgatgacatacccgctcagatagaacccgccggaaaccacccagtgcctcgcaagggcatcgtcgaccccgtgacgaaacctacgcagaccaacaaattccacgggaacctgtacctggacacacgtaaccagacggcttggacccacccatactccgtcgcgtgggcgcaaggctctggcaaggccgggagctggggtcttgccgtgtcccatatcgaccgggacttactagtcttcggcaacgataccgctcaggactctaagactttctttgctgcgccaatcggaatccagtcgctgatcatttcggctgaagaactgggcaatggaaccgccatgacacttgataatctcgaggcctcttccgtcaacgttaacctcgcaccaggtgcgggaaggccacccgtcatcacatacccgctcgtccagggtatggggttcgtgactgggatattcaagggagcgagacctaagatccaaagcagcgtgctgttccgcaaagtaaagggaccgatcgccgtcgggggggtcttcaaataccaggtcactctccgagatggaaagaactggcttatctacgcaaaaccggaccctggctacggcattcccgtcttcaagctggtagacgccacgactctaagagggccaagaggctggcgcggcatcatcagcgtcgccaagaatcccgcgagttccggggctgaagagacgtatgacaaggccgccggcgcttacccgaccgcgatggcaatcaagggctctgtcgacgggacgaccgggaaatacgaattcaacttcgtgaaggctggcgacagctccagaccgttgcttatgttcgcgcttccccatcacgtggagagttttgatgtcgagaccctcagcacccgtacgtccatagagatgtacactaccaccaaaggccttgcaaaggggttcttgagcgacaagtggactatggtagaagagaacctgtcggtaagcatggggttcgcgccgtggaccccagaccggggcagcatcgaaaccctgtcgcgcgaagccgcctgcgtcgtcaacaatgcagcagtccgtgagctccaggaggatatagtgggccagacaaacctcgattcgatgtatttcagcggcaaagccttcgccaagttcgccgccgttatttacgctgtgcacgatttggcagggaacccacaattagcacgtgaaggtctggttaggctgaagaagtcgctggccccgttcattcaaaatactcagcaaaatccgcttgtgtacgacacgacgtggagaggcgtagtgtccactgcgggcttctcggaaccattggcggactttggcagcacctactacaacgaccaccattttcactacggatatttcgtctacaccgcggcagtgatcgcgtatttagacccgtcctggctctcggaagggaccaacaaggcttggatagacatgcttgtcagagactatgccaacccggtcgatgacggtgattttcccttcagccgcgcatttgactggttccatggccacagttgggcaaaaggagtcttctcctcaattgacggaaaagaccaagagtcgacatctgaggactcgttcgcaacttactccatgaaaatgtggggccgagtaacgggtgacgtcgctttggaggcgagagcaacgcttatgctaagcatacaggctcggagcttccagaactatttcctaatggaagaagacaacgctaaccagccgcgagagatgatcaataacaaagtgactggcatcttatgggagaatcgagtggcctggactacttacttcggagatttttggttttataagcagggcatccacatgatccccgtccatgtgccgtcaactctgatccgcacaaagcaatttgtgcaagaggaatatgacatattcttaagcaatggcgccattgatactgcccaagagggttggaggggtattctctatgccaacctcgctcttatcgatgcggacacttcatacgacttcttttcggacccttccttcaacaccacttacttagatgggggcgctagccggacctggtatttggcttatgtgtctgccctaaggggtcattga

SEQ ID NO: 162 - protein, 777 aa, M. phaseolina
MAPSKFLSSSQSRQWFSLLRLAQTRKLMGTLLKHTSDIRSFNAPSGGSCRSNYTFVQPRPKKPTALECTDIFAPLQHDDIPAQIEPAGNHPVPRKGIVDPVTKPTQTNKFHGNLYLDTRNQTAWTHPYSVAWAQGSGKAGSWGLAVSHIDRDLLVFGNDTAQDSKTFFAAPIGIQSLIISAEELGNGTAMTLDNLEASSVNVNLAPGAGRPPVITYPLVQGMGFVTGIFKGARPKIQSSVLFRKVKGPIAVGGVFKYQVTLRDGKNWLIYAKPDPGYGIPVFKLVDATTLRGPRGWRGIISVAKNPASSGAEETYDKAAGAYPTAMAIKGSVDGTTGKYEFNFVKAGDSSRPLLMFALPHHVESFDVETLSTRTSIEMYTTTKGLAKGFLSDKWTMVEENLSVSMGFAPWTPDRGSIETLSREAACVVNNAAVRELQEDIVGQTNLDSMYFSGKAFAKFAAVIYAVHDLAGNPQLAREGLVRLKKSLAPFIQNTQQNPLVYDTTWRGVVSTAGFSEPLADFGSTYYNDHHFHYGYFVYTAAVIAYLDPSWLSEGTNKAWIDMLVRDYANPVDDGDFPFSRAFDWFHGHSWAKGVFSSIDGKDQESTSEDSFATYSMKMWGRVTGDVALEARATLMLSIQARSFQNYFLMEEDNANQPREMINNKVTGILWENRVAWTTYFGDFWFYKQGIHMIPVHVPSTLIRTKQFVQEEYDIFLSNGAIDTAQEGWRGILYANLALIDADTSYDFFSDPSFNTTYLDGGASRTWYLAYVSALRGH

SEQ ID NO: 163 - DNA, 3445 bp, M. phaseolina
ctctggaatttcctttcttggcgagagccacaaccatttttcttcttcctccgccagatccctgatatggcattcccaacttctttatcttttctgtatctcattaacatgctttgctttgccgcgggagcaaccgtctttctgacaaccatgcagttccaaggcgcagcggcccatccgctggcccagcctcagctgcttgaagacagtacgtactcggcaagcgcaccatcagcagggaaactcagccgggtcccgacacctgtctgcaacaactctcccccattgaccgtcaccaaaaccgtctacggtgcctcatacgaattgacgacaccgtcctcttgcttgtcgaccacaactaaccagataacttcttgtgccacgtcaggttttccctccctatatactgcttcttccgcagacctaacgccgacttcgactcctacgacccctacgtctattgcggccccctttgaactctctatcggcgctaccgcctctcctattttgcagtccattgctcctccccttgaaccgcaaccgactggcatcgtccatacaacgctcgagctgtatccccaagttaccactggagttccgtggcatcgcatatgtaagccttcagtctcagttcgcgctggcgttcctccagagctggaattggcttgttcaacgctcagctcacttcctgcccttctcggcatccagcggaaattatgatttgctttcagctgccgtttcatccccggctttttctgggcgaatgctaatgacacacgtcagcgcctactcctgcacccaacgtcgctgcttgtcgaaacaactacagtcgtcctctgactccagtctaccaaccgaatccgaacgcatatccatacaagtttaacagcatggattcggctaacatcttcgccgccgtcccgggcgatgcgtccattccctcgcagatagcgccgcgatcacctcatccacagccatttttgggcattgagggtgctggaactaccccgttgcagaccaacaagttctatgccaacctgtttctgggtcagaggaaccagtccgtctggacccacccctactctgtttccaaatccattggacagtctccggctggaagctggggcctcgcagtatcccacattgaccgctctcaacttgcatttggaccggccacggaccaagacagtgctcgtttcttcatttccccaatcgggatccagtccctgattctctctgccacagaacttgggcccaacagcaacatgactgtggacacgcttgaggacatgtctgtcaatctcaacttggctcctagtgttggtgcacagcccatcatcacattcccagtagttcaaggtatgggcttcgttactggcatctacaagaacgcacagccaagcatcgattctggtgtcttctaccgcaacgttagcgggcctttccagcttggcagcacctacaagtacagcattcttctggaagacggcaagaactgggttctgtacgccactcctgacagcgcaaatggtgctcctgtgttctctctggactccaacaccacgctgaccgggcccgctaactggagtggaaccatcatggtttcgaagaacacggcaggtgccgacggcgaggcagtccttgacagatctgccggtgtctaccctgtatcggtcgacatcttcggcagcgcctccggtgccgccgctcagtatggcttccgctttggcaaggctggcgaggtccagaagactttgttccactacgcactgccgcatcacgtccagagcttcgatgccaacaccgccgcaagacaaactctacttacattgaacactaccaccaagggcattgcaactggttttacagccgacagctggaccatggttgagccaaatcttcccgtggatatgagctttgccccgtggtcgcttgaccgaggcaacctcccgactatctcggccactgctcagtgtgcggttgttgcggctgccgaggctgagttacagcaggatattccagcgcagacgaaccttgactcgatgtatttcagcggcaaaggtcttgccaagtttgcaactattgtctatgctgcccgggacctcgggggcaacgctgagcttgccaaccagggactcaaggagctcaaggctgcctttgatgttttcgtcaacaaccaacagaggaatccgctcgtgtacgacagctcgtggaagggtgttgtctccagtgctggctacggggatcccaacgcggactttggcaactcgtactacaacgaccatcacttccattacggataccagtaggtcacaccgcggctggagtctatgcttttactgatcaggctgcagtgtgtacacggctgccgtgatcgggtaccttgatccgtcctggctcaccgagaagaacgtcaactatgtgaacactctggcgagggactttgcgaacccaattcgtagcagccaatttcctttcagccgcgccttcgactggtttaagtgagttgctcggccttcggtcgctttagtacggcgctaacgcatggcagtgggcatagttgggcaaagggcctcttcgaatctgctgatggcaaggatcaggagtcatcttctgaggtcagtcaccgagtacctccacgctgtgcgggaactgaccacgcataggattctttcgcgtcgtacggtctgaagttgtggggtaaggtcatcggagatgctaacatggaggcaagaggtgagtcgatgcagcgagcgtctgatgggcgttgttgacacgaggttcggcagcgaccctgatgctggctattcaaaatcgaagcttcaacaactatttcctgatgcagagctcgaacacgattcagcctcggcagattatcaacaacaaggtgactggcattctattcgagaataaggtcgactgggctacgtactttagcgatgcatggtggtgcaagcaggggtatgttacagtcacaacggaagcagtgcaggctcccaagcacacggcactgacttacggctgcagaatccacatgatccctgtccatgtcccctcggcatacatcaggaaaccgagttttgtcagagaggagtacgacactttcatgagcaacgggcgtattgcacaggccgagggcggctggagaggcattctggagtccaacctggcgctcgtcgatccaggcacagcgtacaacttcttcgcggacccgaacttcaacatgacgcttctggacggcggagcaagcttaacgtggtacctcgcatattcggcagcgcttgcgggattgtgaaactgaggtgccgggacggaataatttcttgctttaacgattcttccccctatggtattgtccttcctaccgctcggcctttggtttcttcctggcgcacgggcaggcccgttgtcaacccttttaaacttcacctaagtagctttgttc

SEQ ID NO: 164 - DNA, 2529 bp, M. phaseolina
atgcagttccaaggcgcagcggcccatccgctggcccagcctcagctgcttgaagacagttttccctccctatatactgcttcttccgcagacctaacgccgacttcgactcctacgacccctacgtctattgcggccccctttgaactctctatcggcgctaccgcctctcctattttgcagtccattgctcctccccttgaaccgcaaccgactggcatcgtccatacaacgctcgagctgtatccccaagttaccactggagttccgtggcatcgcatatcgcctactcctgcacccaacgtcgctgcttgtcgaaacaactacagtcgtcctctgactccagtctaccaaccgaatccgaacgcatatccatacaagtttaacagcatggattcggctaacatcttcgccgccgtcccgggcgatgcgtccattccctcgcagatagcgccgcgatcacctcatccacagccatttttgggcattgagggtgctggaactaccccgttgcagaccaacaagttctatgccaacctgtttctgggtcagaggaaccagtccgtctggacccacccctactctgtttccaaatccattggacagtctccggctggaagctggggcctcgcagtatcccacattgaccgctctcaacttgcatttggaccggccacggaccaagacagtgctcgtttcttcatttccccaatcgggatccagtccctgattctctctgccacagaacttgggcccaacagcaacatgactgtggacacgcttgaggacatgtctgtcaatctcaacttggctcctagtgttggtgcacagcccatcatcacattcccagtagttcaaggtatgggcttcgttactggcatctacaagaacgcacagccaagcatcgattctggtgtcttctaccgcaacgttagcgggcctttccagcttggcagcacctacaagtacagcattcttctggaagacggcaagaactgggttctgtacgccactcctgacagcgcaaatggtgctcctgtgttctctctggactccaacaccacgctgaccgggcccgctaactggagtggaaccatcatggtttcgaagaacacggcaggtgccgacggcgaggcagtccttgacagatctgccggtgtctaccctgtatcggtcgacatcttcggcagcgcctccggtgccgccgctcagtatggcttccgctttggcaaggctggcgaggtccagaagactttgttccactacgcactgccgcatcacgtccagagcttcgatgccaacaccgccgcaagacaaactctacttacattgaacactaccaccaagggcattgcaactggttttacagccgacagctggaccatggttgagccaaatcttcccgtggatatgagctttgccccgtggtcgcttgaccgaggcaacctcccgactatctcggccactgctcagtgtgcggttgttgcggctgccgaggctgagttacagcaggatattccagcgcagacgaaccttgactcgatgtatttcagcggcaaaggtcttgccaagtttgcaactattgtctatgctgcccgggacctcgggggcaacgctgagcttgccaaccagggactcaaggagctcaaggctgcctttgatgttttcgtcaacaaccaacagaggaatccgctcgtgtacgacagctcgtggaagggtgttgtctccagtgctggctacggggatcccaacgcggactttggcaactcgtactacaacgaccatcacttccattacggataccatgtgtacacggctgccgtgatcgggtaccttgatccgtcctggctcaccgagaagaacgtcaactatgtgaacactctggcgagggactttgcgaacccaattcgtagcagccaatttcctttcagccgcgccttcgactggtttaatgggcatagttgggcaaagggcctcttcgaatctgctgatggcaaggatcaggagtcatcttctgaggattctttcgcgtcgtacggtctgaagttgtggggtaaggtcatcggagatgctaacatggaggcaagagcgaccctgatgctggctattcaaaatcgaagcttcaacaactatttcctgatgcagagctcgaacacgattcagcctcggcagattatcaacaacaaggtgactggcattctattcgagaataaggtcgactgggctacgtactttagcgatgcatggtggtgcaagcagggaatccacatgatccctgtccatgtcccctcggcatacatcaggaaaccgagttttgtcagagaggagtacgacactttcatgagcaacgggcgtattgcacaggccgagggcggctggagaggcattctggagtccaacctggcgctcgtcgatccaggcacagcgtacaacttcttcgcggacccgaacttcaacatgacgcttctggacggcggagcaagcttaacgtggtacctcgcatattcggcagcgcttgcgggattgtga

SEQ ID NO: 165 - protein, 842 aa, M. phaseolina
MQFQGAAAHPLAQPQLLEDSFPSLYTASSADLTPTSTPTTPTSIAAPFELSIGATASPILQSIAPPLEPQPTGIVHTTLELYPQVTTGVPWHRISPTPAPNVAACRNNYSRPLTPVYQPNPNAYPYKFNSMDSANIFAAVPGDASIPSQIAPRSPHPQPFLGIEGAGTTPLQTNKFYANLFLGQRNQSVWTHPYSVSKSIGQSPAGSWGLAVSHIDRSQLAFGPATDQDSARFFISPIGIQSLILSATELGPNSNMTVDTLEDMSVNLNLAPSVGAQPIITFPVVQGMGFVTGIYKNAQPSIDSGVFYRNVSGPFQLGSTYKYSILLEDGKNWVLYATPDSANGAPVFSLDSNTTLTGPANWSGTIMVSKNTAGADGEAVLDRSAGVYPVSVDIFGSASGAAAQYGFRFGKAGEVQKTLFHYALPHHVQSFDANTAARQTLLTLNTTTKGIATGFTADSWTMVEPNLPVDMSFAPWSLDRGNLPTISATAQCAVVAAAEAELQQDIPAQTNLDSMYFSGKGLAKFATIVYAARDLGGNAELANQGLKELKAAFDVFVNNQQRNPLVYDSSWKGVVSSAGYGDPNADFGNSYYNDHHFHYGYHVYTAAVIGYLDPSWLTEKNVNYVNTLARDFANPIRSSQFPFSRAFDWFNGHSWAKGLFESADGKDQESSSEDSFASYGLKLWGKVIGDANMEARATLMLAIQNRSFNNYFLMQSSNTIQPRQIINNKVTGILFENKVDWATYFSDAWWCKQGIHMIPVHVPSAYIRKPSFVREEYDTFMSNGRIAQAEGGWRGILESNLALVDPGTAYNFFADPNFNMTLLDGGASLTWYLAYSAALAGL

SEQ ID NO: 166 - DNA, 3878 bp, M. phaseolina
cgttcagcatcgtcgcttcagcgtgcgtgtcatgtcttcttgacgaatcagccttggcgttctgtagcctcatcctcagcctcgcattgggtacatatcggtctttgttttcgttatttcaattttctgtggtgtttttcaggtctcaaaatgccttgggccggccaagacaaaacttacacttccagcgacgagacgcatccgaagcaccgcgacccattccggtttatccccgcggacgacttctacgagttcttttctggaaagcaccgcccaacatcagttacatgcaagccagaagatcaagccgtcgaggacaagacgaggaatgcggcatgccacaatggcaggatcttccgctttaacgatgacacacttatgctcattcaattcatccggcctcttgtttggagaatccagtttgatccgaatcgccaaaaagggtcggagtacacggactggaatacgtgagttttgccggatatctaaatgcagctagtccgcttacagtctgcagaaagtcattactggagggaagattgtccaaaatgacgcgcgttctcgacactgcagaagagatagtctgggatgtcgagtttgaccctactcacgtcacgcatttcatccttcgctcgatcattgtctccagagggaagcgagttcccgttgttgagttatggattcagcgaaatccatttagaatcaccgctattcggcggatcaaaacccggttgacgccggaagtttctccttatggtgacatctcagttgatattccgggccctggaagagccatcatctggcagacaacggagaaccccctacggcacgacgggcgggctacaatactctcagtcgagaagaaaccgcaggcaaagtacatgggctttggtggccaaggcggaaaaaacttgttcaaagataacacttacctgaactacttcagtgagacatcagcccctttctgatggaacaggctcgcctaatcatggacccagatttcgataacatgcggtacaacaatatctacgctaaggggcctgaagaggccgcagaaccattgtaccattcggagcccttttggatcgaaatcaacaggcatccaagctacatgtcccaggtggcaactttcatcgacaatttctcccaagtctgccttgatgtcggcaagactgacaggagctccttccgcattgcaaccagattcaacagcttccaagctattttcatggccggtaacaccattgcggagatcatcagattgtatacttccctgatcggcaaaccaaggctgatgcctcgatacgtccttggaaatcaccaaggctgctatggatatgaccgtcaatggaaggttgaagaggtggtacgaaaataccgcgagtatgatattccgctggacgggatgcacatcgacgttgacatgcagagaggataccgcacatttacaattgatagggacagatttcctgagccggagaagatgttccttgaattgcgtaagcaaggcgtgcgttgcagcaccaacatcacgcctgtcatcaactgcatacctgacacctcttacgtccctctgaacgaaggcctggctgagaatcattttgttctggacaaaagggatatcgatccatcagcgccaacttgccatgaccagaggtatatgcagtacggaaatgcggatctttactttacaaacccgaatgatgtggaccgcaggccttacccagatgaatacgactttgaggctcacttcaacaaatccgttcctttccacgggggcgtctcctacggcgatgggcaaggtgcaccaggccattacccgaatctgaacaacaagcgcactcgagaatggtggggaaagcagtacaaagacctcttcgacgcagggcttgagttcatctggcaggacatgacgtccccttgcataggtgatgcatacggagacatgaagtcgtggccgttccggcttctactcgagtctgacagctggcgaggagaacaacgccgcaggagactcagcattccggcacctgccgataaggaagagctcaagactgctatcgagctttggtcactgtatagcctcaacctacataaggcgacttttaaagggctcaagcggttggaaagccggaaaggaaagcggaacttcatcattggaaggggcagtttcgccggcgcccagcgctatgccggactctggactggcgataatgcatctacttgggagttcctcagtgtctcaatctcgcaggtcctttctcttggtctttcaggcatgacgatggctggcgctgatgttgggggttttgagcttgcgcttggagagtcgaagttcgccgatcctgagcttctgatccgctggtactgtgcgaacagcttacttccgtggtttaggtgagcaatgaagctcctttaaacagaacaaatgctaacgaactgcaggaatcattacagtgggaggcacgaacctttcgaggatcgaccagatcagccgcgggattgtgacaagaagctgttccaagaaccgtacaaatacgaggaatactaccgcgaaaacagagacagtatgcccgaaaaggagagagcaatatttgaggctgttcttccggtgtgccgttactacgtacatctgcgatacagccttctccaagtcctttacgacgccatgttcgaaagcacaattaccggcatgcccatcgcaagagccatggtaaacgcactcagcccaactcgcacaacaccccgtgctgacagcgtctcaggtcattacagacgccctcgacgcgtccctcctcacggccaacagtgcctacgcctccacccaatacctcgccggcccctccctccttgtcgcgccgtccctttcgccctcctctagccgcgacgtctacctccccacgacatcctcctggtacccgctcaacctccgcccatgcacgaccgcgtcctcctccctcggcggcgtcccgctcctgcccgccgtcgcgggcggcacgcacctgacttacgactgccgcatcagcgcgctgcccacccaactgccctacgcctgcccgacgtacgtccgctcgggcgccatcatcccgcagatcctcgtgcgcgccagcacacccgaccgcaccttcgcgccggcctcgtcttctcccccgtcgtccgtgccctcgctgcaacaccagccccctaaccccatcaccatccacgtctaccccggccccccgaatggcgagaagggctacacctaccacatgtacctcgacgatggcgtgtcgcgcgccagtgcgcccggggcggcgtacttcgccacgctgccggtgccggtcgaggaggatgcagtcgcggtgggcggattgggtagggtgagcgcggcgtatggggataaggaggctgggagcgagtttcggcgggtcgatgttacgcaatggataagcgcggcgggagaggatggggatgcggtggggaggaggaggaggaggattgaggtggggacggggtgggatgggtatggggatgagagggtgaggagggatgttggagatgagtataaggtcgtggtttggcatgaggaggggacggtgatgggcgaggtgagcgtgcaggtggaagcggggggttgtgaggcgggcaggagagagagggatgagggtgcgagggcggatgtcgtgtgggtgccggtggataaggaggtgaagacgacgattgtggtgacttatggtgggagtggttgagggggggtgtggggcattgatgatgagggggatcggaacctctgtgaatcgagatgctggcctgaggcaactatcaggtgagctcacattgctgtatagaaggctcagacccaaaggccattttctgtcagtgattagcggcttgtgatt

SEQ ID NO: 167 - DNA, 3363 bp, M. phaseolina
atgccttgggccggccaagacaaaacttacacttccagcgacgagacgcatccgaagcaccgcgacccattccggtttatccccgcggacgacttctacgagttcttttctggaaagcaccgcccaacatcagttacatgcaagccagaagatcaagccgtcgaggacaagacgaggaatgcggcatgccacaatggcaggatcttccgctttaacgatgacacacttatgctcattcaattcatccggcctcttgtttggagaatccagtttgatccgaatcgccaaaaagggtcggagtacacggactggaatacaaagtcattactggagggaagattgtccaaaatgacgcgcgttctcgacactgcagaagagatagtctgggatgtcgagtttgaccctactcacgtcacgcatttcatccttcgctcgatcattgtctccagagggaagcgagttcccgttgttgagttatggattcagcgaaatccatttagaatcaccgctattcggcggatcaaaacccggttgacgccggaagtttctccttatggtgacatctcagttgatattccgggccctggaagagccatcatctggcagacaacggagaaccccctacggcacgacgggcgggctacaatactctcagtcgagaagaaaccgcaggcaaagtacatgggctttggtggccaaggcggaaaaaacttgttcaaagataacacttacctgaactacttcaatttcgataacatgcggtacaacaatatctacgctaaggggcctgaagaggccgcagaaccattgtaccattcggagcccttttggatcgaaatcaacaggcatccaagctacatgtcccaggtggcaactttcatcgacaatttctcccaagtctgccttgatgtcggcaagactgacaggagctccttccgcattgcaaccagattcaacagcttccaagctattttcatggccggtaacaccattgcggagatcatcagattgtatacttccctgatcggcaaaccaaggctgatgcctcgatacgtccttggaaatcaccaaggctgctatggatatgaccgtcaatggaaggttgaagaggtggtacgaaaataccgcgagtatgatattccgctggacgggatgcacatcgacgttgacatgcagagaggataccgcacatttacaattgatagggacagatttcctgagccggagaagatgttccttgaattgcgtaagcaaggcgtgcgttgcagcaccaacatcacgcctgtcatcaactgcatacctgacacctcttacgtccctctgaacgaaggcctggctgagaatcattttgttctggacaaaagggatatcgatccatcagcgccaacttgccatgaccagaggtatatgcagtacggaaatgcggatctttactttacaaacccgaatgatgtggaccgcaggccttacccagatgaatacgactttgaggctcacttcaacaaatccgttcctttccacgggggcgtctcctacggcgatgggcaaggtgcaccaggccattacccgaatctgaacaacaagcgcactcgagaatggtggggaaagcagtacaaagacctcttcgacgcagggcttgagttcatctggcaggacatgacgtccccttgcataggtgatgcatacggagacatgaagtcgtggccgttccggcttctactcgagtctgacagctggcgaggagaacaacgccgcaggagactcagcattccggcacctgccgataaggaagagctcaagactgctatcgagctttggtcactgtatagcctcaacctacataaggcgacttttaaagggctcaagcggttggaaagccggaaaggaaagcggaacttcatcattggaaggggcagtttcgccggcgcccagcgctatgccggactctggactggcgataatgcatctacttgggagttcctcagtgtctcaatctcgcaggtcctttctcttggtctttcaggcatgacgatggctggcgctgatgttgggggttttgagcttgcgcttggagagtcgaagttcgccgatcctgagcttctgatccgctggtactgtgcgaacagcttacttccgtggtttagtgggaggcacgaacctttcgaggatcgaccagatcagccgcgggattgtgacaagaagctgttccaagaaccgtacaaatacgaggaatactaccgcgaaaacagagacagtatgcccgaaaaggagagagcaatatttgaggctgttcttccggtgtgccgttactacgtacatctgcgatacagccttctccaagtcctttacgacgccatgttcgaaagcacaattaccggcatgcccatcgcaagagccatggtcattacagacgccctcgacgcgtccctcctcacggccaacagtgcctacgcctccacccaatacctcgccggcccctccctccttgtcgcgccgtccctttcgccctcctctagccgcgacgtctacctccccacgacatcctcctggtacccgctcaacctccgcccatgcacgaccgcgtcctcctccctcggcggcgtcccgctcctgcccgccgtcgcgggcggcacgcacctgacttacgactgccgcatcagcgcgctgcccacccaactgccctacgcctgcccgacgtacgtccgctcgggcgccatcatcccgcagatcctcgtgcgcgccagcacacccgaccgcaccttcgcgccggcctcgtcttctcccccgtcgtccgtgccctcgctgcaacaccagccccctaaccccatcaccatccacgtctaccccggccccccgaatggcgagaagggctacacctaccacatgtacctcgacgatggcgtgtcgcgcgccagtgcgcccggggcggcgtacttcgccacgctgccggtgccggtcgaggaggatgcagtcgcggtgggcggattgggtagggtgagcgcggcgtatggggataaggaggctgggagcgagtttcggcgggtcgatgttacgcaatggataagcgcggcgggagaggatggggatgcggtggggaggaggaggaggaggattgaggtggggacggggtgggatgggtatggggatgagagggtgaggagggatgttggagatgagtataaggtcgtggtttggcatgaggaggggacggtgatgggcgaggtgagcgtgcaggtggaagcggggggttgtgaggcgggcaggagagagagggatgagggtgcgagggcggatgtcgtgtgggtgccggtggataaggaggtgaagacgacgattgtggtgacttatggtgggagtggttga

SEQ ID NO: 168 - protein, 1120 aa, M. phaseolina
MPWAGQDKTYTSSDETHPKHRDPFRFIPADDFYEFFSGKHRPTSVTCKPEDQAVEDKTRNAACHNGRIFRFNDDTLMLIQFIRPLVWRIQFDPNRQKGSEYTDWNTKSLLEGRLSKMTRVLDTAEEIVWDVEFDPTHVTHFILRSIIVSRGKRVPVVELWIQRNPFRITAIRRIKTRLTPEVSPYGDISVDIPGPGRAIIWQTTENPLRHDGRATILSVEKKPQAKYMGFGGQGGKNLFKDNTYLNYFNFDNMRYNNIYAKGPEEAAEPLYHSEPFWIEINRHPSYMSQVATFIDNFSQVCLDVGKTDRSSFRIATRFNSFQAIFMAGNTIAEIIRLYTSLIGKPRLMPRYVLGNHQGCYGYDRQWKVEEVVRKYREYDIPLDGMHIDVDMQRGYRTFTIDRDRFPEPEKMFLELRKQGVRCSTNITPVINCIPDTSYVPLNEGLAENHFVLDKRDIDPSAPTCHDQRYMQYGNADLYFTNPNDVDRRPYPDEYDFEAHFNKSVPFHGGVSYGDGQGAPGHYPNLNNKRTREWWGKQYKDLFDAGLEFIWQDMTSPCIGDAYGDMKSWPFRLLLESDSWRGEQRRRRLSIPAPADKEELKTAIELWSLYSLNLHKATFKGLKRLESRKGKRNFIIGRGSFAGAQRYAGLWTGDNASTWEFLSVSISQVLSLGLSGMTMAGADVGGFELALGESKFADPELLIRWYCANSLLPWFSGRHEPFEDRPDQPRDCDKKLFQEPYKYEEYYRENRDSMPEKERAIFEAVLPVCRYYVHLRYSLLQVLYDAMFESTITGMPIARAMVITDALDASLLTANSAYASTQYLAGPSLLVAPSLSPSSSRDVYLPTTSSWYPLNLRPCTTASSSLGGVPLLPAVAGGTHLTYDCRISALPTQLPYACPTYVRSGAIIPQILVRASTPDRTFAPASSSPPSSVPSLQHQPPNPITIHVYPGPPNGEKGYTYHMYLDDGVSRASAPGAAYFATLPVPVEEDAVAVGGLGRVSAAYGDKEAGSEFRRVDVTQWISAAGEDGDAVGRRRRRIEVGTGWDGYGDERVRRDVGDEYKVVVWHEEGTVMGEVSVQVEAGGCEAGRRERDEGARADVVWVPVDKEVKTTIVVTYGGSG

SEQ ID NO: 169 - DNA, 4339 bp, M. phaseolina
acgggctaccgtccatactgtggccttctttgcgactcttgttctgtcgaagcctggcagctgtacttcagcgcacgttttcttccccgaagcccagggaagtcctgagaattcctcgcacgaacccatcagacattgaacctgcccaatatgcctgatgccacgatcggaacccaggatgagaaccaccccaaacatcgcgatccataccgcttcatcccggcagatgagttcttcgacagagagctcctgactggcactgtcaggccggattctgtcacgttcagtgagaaggatcagctcgatgccaccgggaaaaagctcaatccggcttgcggccatggccgagtgtttcgacttagcactggcgccgtcatgttgatccagttcatgcgtcccttggtgtggcgcatcagattctatccgcactacaaggaaggacatgatttcaccgactacaacacgtacgtccaccgaccactctctgctccgcgcagcggcacgacgcttaggctgacatttctgcaggaggaccatcatcaggggcaatttgtccaacatgatagacatattggaccgcgctgaaggcatcacatggtctgtgcaattcgacgacagcaacccgcgctactacattctcagatccgtcgacggaaacggcaagccggtagttcagctctggattcagcgcgaccccttcagaatcatcgccaccaggaccatcaagacccccggaaagctcaagatgcatgtccgcgacgatgaggaaagtcaccttcccattacagccccggcggaatcgggacaggccgtcatttggaagacgaagaagaggcctctgcagtatcaagttcgtggctcggacaaggagccatgtgccattgtgctttctgttgagaaacccgatcctgcgaggttcatgggcttcggcgagcagggcggcaaggatctgttcaaggataacactttcatgaattacttcagtaagcaagcccgtgtccaggagcttacatatggcgtgacagctaatctcgtgcacagactttgacaacatgcggtacaataacgtctacgggcgcggcccgtttgaggatgccgagcctctgtaccactcaggcaagacatctcgactcacatcaacgtgctttacactgactgtacatagaaccctacttcatcgaagtcaatggccatccgggatagtgagacgagccattgatatacctctattacttgccagtgctaatgcatatgacagcatgtctcaattggcgaccttcatcgacaactactcgcatgtttgcgtggatcttggcaaaaccaataccactcaggttcgcattgccacacgcttcaatggcttccaaggcatcttcattgccggaaacgacatcagcgaggtgatccgtcgctactcgtcgctcatcgggcggccaaggctgatgccacgcttcgtgcttggcaaccaccaaggctgctatggatacgaccatcagcagagagtggagcaggcggttcagaaatatcgcgattacggcatcccgcttggtatgacctctcaattccgccattgggcgcgtgcttacctgaaacccagatggcatgcatatcgatgtcgacatgcaacgtgactacaggaccttcaccatcgacaaagggaagttcccggagcctgagaagatgttcttggagttgcgcaagaaaggcgtccgctgtagcaccaacatcactcccgtcatcaatgccaataatgatgcggattacaccacgctgaacgatggcctcgccaacaaccacttcgtgttggatcggcgcaacatcgatccgtctgcaccgaactggttcgaccaacgttacatgcagtatggcggctcgcagatgtactacacgcgtccgtttgtgcccagcgatgctgaagagcctgatgacaatcatgactttagcgcgtctttcaacaaagctgaccagggccagcttttccgtggtggcgtctcctatgggaacaagcaaggctgtcctgggtactatcctaatctgaaccaaagaagaactcgagactggtggggcaagcagtacgagtacctgttcaacactgggcttgagttcgtgtggcaggacatgacatccccctgcatggctcagcgatacggagacatgaagtcgtaagttcccaagcctataagtacacggcctcgcagctgatcggtattacagatggccgttccgtctcatgcttgactccgacggttggcctggtgagaccaaagctctggtcagagacccggatcagaccgatcagaaggcggccatcgagatctggtctctgtacagctttaacctgcacaaggccaccttcaagggtctcaaccatctcgactgtcgcaagggcaaacgcaacttcatcatcggcaggggtagctacgccggcgctcagcgctacgccggcctctggaccggagacaacgcttcgacctgggactttttacaaatctccgtcgcccaggtcatcgcgctcggcttggcaggagtgacgattgcgggcgccgacgtgggcggattcgagcctcccgaaggagacctcaccgcgttcgctgacccggaactgctgatccgctggtactgcgcgtacagtcttctcccttggttcaggtcagtttgggaactccctaaatgcatagcgattctaactctattgcagaaaccactacagcgccaagcatactggcaaggaaaacattgactggaagaagaaggactttcaggtgagtgacatcggcggtccatgcattactccgaggctaatccgcacaaggagccatatcggtatgacgaatggtaccgtgaacactggagggaggttatggatggagagcgctatatctacgagtcggtcttgccggtcagcagatactatatccgcctccgctacagcctcttgcaactgctgtatgatgccatgttcgagaacagcatcacaggattgcccattgcaagatcactggtcatcactgatccgctggatggcagtctcttctcgagggtaaaagacgtgaaaaaaattctttcctggcacctaagctaaccgttaaccagcacgaatgggcaaacaagagccaatacatggtccgtaatgacatcctcgtggccccgcagctggaacaaaagcgggcgaggcgcgagatctacttcccgtccaccaactcgtggttccctttgaacctgcgtccgcactacgatgacggcatcggcgagcctttgcagcccagggtccagggcggcgccaacatatcctacgactgccacattgccgcgcaggacggccagcttccctacgtctgtccgatgtacatccgagaaggtactctccccaagtcctgccaacacgcaaacattcactcacacccaccaggtgccatcatcccccaaattcaggtccgggactgcgtgcccgaccgcactcggccggagctcccgtcggcgcccgccaaccccatcacgatcaacatctacccgggccactcctcggtgagtctcatcaaaagacgcttcagcagccccgtccgaggcatctatctctttacttacaattctgtccagcgcggcccgagcaagtactccatgtacctggacgacggcgtctcgcgcagcagcgcgcccgatgacgcctacctgttcttgcagccgacagacgcggtggacgaggcgcaggcgcgcccgaacaacgagtacggcgacaaggcggcccgcagcaacttccggcgcgtcgatatcgagcaggtaagaaccaacaaccccctcccctgggttgggtggggggcgggggctttcagtgcgcctgcgacgacgactactgacacggagttctcaggtaatcaccgacacggacgacgccaaggtgacccacaggcgcatcaagctctttacgtactggaagggcagcttgctcgaccccaaggacgcggagaagtatgacgatgcgcaggtcaagcgagatgtcggcgacgagtaccgtctcgttatctggcacgaggccgaaaccgacatgagcaaggtctctgtcagcgtggtgcgtgctggcaccaacgacgaccgggtcagggtcatcaaggacgtcggaaagaaggcgtccatggtatgggtgcccacggagaagcacgtcgaggcggaagttgaggtcaagtatgagtgaaagtcgtcgttttcttatagtagctgcagcttccggcaagcggcaggcagccattctcattaagtgcaagggatctgaatgattttatggtgtgtcagcgggagaataatatgttggcgttattgattattgccagaaattgagtctatc

SEQ ID NO: 170 - DNA, 3345 bp, M. phaseolina
atgcctgatgccacgatcggaacccaggatgagaaccaccccaaacatcgcgatccataccgcttcatcccggcagatgagttcttcgacagagagctcctgactggcactgtcaggccggattctgtcacgttcagtgagaaggatcagctcgatgccaccgggaaaaagctcaatccggcttgcggccatggccgagtgtttcgacttagcactggcgccgtcatgttgatccagttcatgcgtcccttggtgtggcgcatcagattctatccgcactacaaggaaggacatgatttcaccgactacaacacgaggaccatcatcaggggcaatttgtccaacatgatagacatattggaccgcgctgaaggcatcacatggtctgtgcaattcgacgacagcaacccgcgctactacattctcagatccgtcgacggaaacggcaagccggtagttcagctctggattcagcgcgaccccttcagaatcatcgccaccaggaccatcaagacccccggaaagctcaagatgcatgtccgcgacgatgaggaaagtcaccttcccattacagccccggcggaatcgggacaggccgtcatttggaagacgaagaagaggcctctgcagtatcaagttcgtggctcggacaaggagccatgtgccattgtgctttctgttgagaaacccgatcctgcgaggttcatgggcttcggcgagcagggcggcaaggatctgttcaaggataacactttcatgaattacttcaactttgacaacatgcggtacaataacgtctacgggcgcggcccgtttgaggatgccgagcctctgtaccactcagaaccctacttcatcgaagtcaatggccatccgggatacatgtctcaattggcgaccttcatcgacaactactcgcatgtttgcgtggatcttggcaaaaccaataccactcaggttcgcattgccacacgcttcaatggcttccaaggcatcttcattgccggaaacgacatcagcgaggtgatccgtcgctactcgtcgctcatcgggcggccaaggctgatgccacgcttcgtgcttggcaaccaccaaggctgctatggatacgaccatcagcagagagtggagcaggcggttcagaaatatcgcgattacggcatcccgcttgatggcatgcatatcgatgtcgacatgcaacgtgactacaggaccttcaccatcgacaaagggaagttcccggagcctgagaagatgttcttggagttgcgcaagaaaggcgtccgctgtagcaccaacatcactcccgtcatcaatgccaataatgatgcggattacaccacgctgaacgatggcctcgccaacaaccacttcgtgttggatcggcgcaacatcgatccgtctgcaccgaactggttcgaccaacgttacatgcagtatggcggctcgcagatgtactacacgcgtccgtttgtgcccagcgatgctgaagagcctgatgacaatcatgactttagcgcgtctttcaacaaagctgaccagggccagcttttccgtggtggcgtctcctatgggaacaagcaaggctgtcctgggtactatcctaatctgaaccaaagaagaactcgagactggtggggcaagcagtacgagtacctgttcaacactgggcttgagttcgtgtggcaggacatgacatccccctgcatggctcagcgatacggagacatgaagtcatggccgttccgtctcatgcttgactccgacggttggcctggtgagaccaaagctctggtcagagacccggatcagaccgatcagaaggcggccatcgagatctggtctctgtacagctttaacctgcacaaggccaccttcaagggtctcaaccatctcgactgtcgcaagggcaaacgcaacttcatcatcggcaggggtagctacgccggcgctcagcgctacgccggcctctggaccggagacaacgcttcgacctgggactttttacaaatctccgtcgcccaggtcatcgcgctcggcttggcaggagtgacgattgcgggcgccgacgtgggcggattcgagcctcccgaaggagacctcaccgcgttcgctgacccggaactgctgatccgctggtactgcgcgtacagtcttctcccttggttcagaaaccactacagcgccaagcatactggcaaggaaaacattgactggaagaagaaggactttcaggagccatatcggtatgacgaatggtaccgtgaacactggagggaggttatggatggagagcgctatatctacgagtcggtcttgccggtcagcagatactatatccgcctccgctacagcctcttgcaactgctgtatgatgccatgttcgagaacagcatcacaggattgcccattgcaagatcactggtcatcactgatccgctggatggcagtctcttctcgaggcacgaatgggcaaacaagagccaatacatggtccgtaatgacatcctcgtggccccgcagctggaacaaaagcgggcgaggcgcgagatctacttcccgtccaccaactcgtggttccctttgaacctgcgtccgcactacgatgacggcatcggcgagcctttgcagcccagggtccagggcggcgccaacatatcctacgactgccacattgccgcgcaggacggccagcttccctacgtctgtccgatgtacatccgagaaggtgccatcatcccccaaattcaggtccgggactgcgtgcccgaccgcactcggccggagctcccgtcggcgcccgccaaccccatcacgatcaacatctacccgggccactcctcgcgcggcccgagcaagtactccatgtacctggacgacggcgtctcgcgcagcagcgcgcccgatgacgcctacctgttcttgcagccgacagacgcggtggacgaggcgcaggcgcgcccgaacaacgagtacggcgacaaggcggcccgcagcaacttccggcgcgtcgatatcgagcaggtaatcaccgacacggacgacgccaaggtgacccacaggcgcatcaagctctttacgtactggaagggcagcttgctcgaccccaaggacgcggagaagtatgacgatgcgcaggtcaagcgagatgtcggcgacgagtaccgtctcgttatctggcacgaggccgaaaccgacatgagcaaggtctctgtcagcgtggtgcgtgctggcaccaacgacgaccgggtcagggtcatcaaggacgtcggaaagaaggcgtccatggtatgggtgcccacggagaagcacgtcgaggcggaagttgaggtcaagtatgagtga

SEQ ID NO: 171 - protein, 1114 aa, M. phaseolina
MPDATIGTQDENHPKHRDPYRFIPADEFFDRELLTGTVRPDSVTFSEKDQLDATGKKLNPACGHGRVFRLSTGAVMLIQFMRPLVWRIRFYPHYKEGHDFTDYNTRTIIRGNLSNMIDILDRAEGITWSVQFDDSNPRYYILRSVDGNGKPVVQLWIQRDPFRIIATRTIKTPGKLKMHVRDDEESHLPITAPAESGQAVIWKTKKRPLQYQVRGSDKEPCAIVLSVEKPDPARFMGFGEQGGKDLFKDNTFMNYFNFDNMRYNNVYGRGPFEDAEPLYHSEPYFIEVNGHPGYMSQLATFIDNYSHVCVDLGKTNTTQVRIATRFNGFQGIFIAGNDISEVIRRYSSLIGRPRLMPRFVLGNHQGCYGYDHQQRVEQAVQKYRDYGIPLDGMHIDVDMQRDYRTFTIDKGKFPEPEKMFLELRKKGVRCSTNITPVINANNDADYTTLNDGLANNHFVLDRRNIDPSAPNWFDQRYMQYGGSQMYYTRPFVPSDAEEPDDNHDFSASFNKADQGQLFRGGVSYGNKQGCPGYYPNLNQRRTRDWWGKQYEYLFNTGLEFVWQDMTSPCMAQRYGDMKSWPFRLMLDSDGWPGETKALVRDPDQTDQKAAIEIWSLYSFNLHKATFKGLNHLDCRKGKRNFIIGRGSYAGAQRYAGLWTGDNASTWDFLQISVAQVIALGLAGVTIAGADVGGFEPPEGDLTAFADPELLIRWYCAYSLLPWFRNHYSAKHTGKENIDWKKKDFQEPYRYDEWYREHWREVMDGERYIYESVLPVSRYYIRLRYSLLQLLYDAMFENSITGLPIARSLVITDPLDGSLFSRHEWANKSQYMVRNDILVAPQLEQKRARREIYFPSTNSWFPLNLRPHYDDGIGEPLQPRVQGGANISYDCHIAAQDGQLPYVCPMYIREGAIIPQIQVRDCVPDRTRPELPSAPANPITINIYPGHSSRGPSKYSMYLDDGVSRSSAPDDAYLFLQPTDAVDEAQARPNNEYGDKAARSNFRRVDIEQVITDTDDAKVTHRRIKLFTYWKGSLLDPKDAEKYDDAQVKRDVGDEYRLVIWHEAETDMSKVSVSVVRAGTNDDRVRVIKDVGKKASMVWVPTEKHVEAEVEVKYE

SEQ ID NO: 172 - DNA, 2377 bp, M. phaseolina
ccactgtgctatagagatactcgtggacgtttcgcgtcctaattggccctccgaatcgcttcctttcccattcgggaagtcgagctcacgacaccctcatccagccaagcccatttgctcggaattcagccctcccaccagcccgccaccatgttctcccaagacggccaccgcctcatctaccgctacgacgccgaaacgctctggatcgagccctggggccccaacgccgtccgcgtccgcgccaccaaatgctcgcacatgccggccgacaactgggccctcgacatcacgccgcccgccctcgctgccgctccgacaatcgccatcccccgcgccgggagcggcagcgccaacgccaccctcaccaacggcgccatccgcgcgacgctcacgccccgcggcaaactcaccctgcacaacgcgcacacccaggccctcctcgtggccgaatacgcgcgcaaccggctcgacgtgacggacccgcagtgcagcgcgctcgagatcgcggcgcgcgacttcgcgcccgtccccggcagcgacgcgtacgcgctgacggcgcggttcgagggcgtcgcgcgcggcgagaagctgtacggcatgggccagtaccagcacgggctgctcgacctcgccggcgccgacgtcgagctcgcccagcgcaactcgcaggccagcgtgccgttcctggtcagcagccgcgggtacgggctgctgtggaacaatccgggcgtgggccgggccgtgctgggcaagaacgtgcgcagcttcgaggccgcggccacgcgcgcgctggactactgggttgttgcgggcgacggcgcgggccccaaggcgatcgagcgcgcgtatgcgggcgtgacgggcaaggcgccgatgatgcccgagtacgggctggggttctggcagtgcaagctgcggtaccagacgcaggaggagctgctgggcgtggcgcgggagtaccggaggcgggggctgccgattgatgtgattgtggtcgacttcttccactggccgaggcagggcgagtggaggttcgatccggtcttttggccggatccggatgcgatggtaagggagttgaaggagctgcggattgagctgatggtgtccatctggccgacggtcgacaagcggtcggagcactacgaggagatggtcgagcatggctacctcatccgaacggatcgcgggatccggacggccatggacttccagggcgataccgtccatgccgacttcaccaatcccggggcgcgcgaatacgtctggaagctggtcaagaagaactactgggacaagggcatccgcatcttctggtgcgacgaggcggagcgtaagttatgtcctgtattcacacaaaccccctcccccccgcaacacctcagctcaccccgcagccgaatacaccgtctacgacttcgacaactaccgctaccacgccgggcccaacctgcagatcggcaacctctacccgctgcactacgccgccgccttccacgccggccaacacgctgccggccaaacgcagattgtcaacctgctccgctgcgcgtgggcatcgtcccaaaaatacggcgcccttgtctggagcggcgacatcgcctcgtcctggccgtcgctgcgcgcgcagctggccgccggcctgaacatgggcctcgccggcatcccgtggtggacgaccgacatcggcggcttccacggcggcgatccgcgcgacgccgccttcagggagctgttcgtgcggtggttccagtggggcgccttctgtcccgtcatgcggctgcacggggaccgcgagccgcggcagccgaggctgggcgaaggcggcgggagcgggtgccggagcggtgcgccgaacgaggtgtggtcgtatggcgaggaggtctatgccatttgcgagaggtacttgcgggtgcgcgaggggctgagggcctatacgcgcgaggccatgcgggaagcgcatgaggagggcgatccggtcatgaggacgctgttttatgagttcccggacgatgccagggcgtgggaggtcgaggacgaatacttgttcgggccgaagtacctggtggcgccggtgctatatcccggcatcaagacccggaaggtgtacttccctaagggagcgacctggaaagcgttcgagggggatgcgaagtacgaaggaggaactactgcggaagtggacacgccgattgagtctatcccggtgttcgtcagggaatagccagaaaaaagatggctctactgaccacagcctgagagcaaccgcgacggaaaccaaggcttcgtcttcgggtgaaatgttcggaggagatagaccagcctttgaaatgtgtatggggcaacaaaaaaacaaaaaacgaatcaaagtcat

SEQ ID NO: 173 - DNA, 2025 bp, M. phaseolina
atgttctcccaagacggccaccgcctcatctaccgctacgacgccgaaacgctctggatcgagccctggggccccaacgccgtccgcgtccgcgccaccaaatgctcgcacatgccggccgacaactgggccctcgacatcacgccgcccgccctcgctgccgctccgacaatcgccatcccccgcgccgggagcggcagcgccaacgccaccctcaccaacggcgccatccgcgcgacgctcacgccccgcggcaaactcaccctgcacaacgcgcacacccaggccctcctcgtggccgaatacgcgcgcaaccggctcgacgtgacggacccgcagtgcagcgcgctcgagatcgcggcgcgcgacttcgcgcccgtccccggcagcgacgcgtacgcgctgacggcgcggttcgagggcgtcgcgcgcggcgagaagctgtacggcatgggccagtaccagcacgggctgctcgacctcgccggcgccgacgtcgagctcgcccagcgcaactcgcaggccagcgtgccgttcctggtcagcagccgcgggtacgggctgctgtggaacaatccgggcgtgggccgggccgtgctgggcaagaacgtgcgcagcttcgaggccgcggccacgcgcgcgctggactactgggttgttgcgggcgacggcgcgggccccaaggcgatcgagcgcgcgtatgcgggcgtgacgggcaaggcgccgatgatgcccgagtacgggctggggttctggcagtgcaagctgcggtaccagacgcaggaggagctgctgggcgtggcgcgggagtaccggaggcgggggctgccgattgatgtgattgtggtcgacttcttccactggccgaggcagggcgagtggaggttcgatccggtcttttggccggatccggatgcgatggtaagggagttgaaggagctgcggattgagctgatggtgtccatctggccgacggtcgacaagcggtcggagcactacgaggagatggtcgagcatggctacctcatccgaacggatcgcgggatccggacggccatggacttccagggcgataccgtccatgccgacttcaccaatcccggggcgcgcgaatacgtctggaagctggtcaagaagaactactgggacaagggcatccgcatcttctggtgcgacgaggcggagcctcaccccgcagccgaatacaccgtctacgacttcgacaactaccgctaccacgccgggcccaacctgcagatcggcaacctctacccgctgcactacgccgccgccttccacgccggccaacacgctgccggccaaacgcagattgtcaacctgctccgctgcgcgtgggcatcgtcccaaaaatacggcgcccttgtctggagcggcgacatcgcctcgtcctggccgtcgctgcgcgcgcagctggccgccggcctgaacatgggcctcgccggcatcccgtggtggacgaccgacatcggcggcttccacggcggcgatccgcgcgacgccgccttcagggagctgttcgtgcggtggttccagtggggcgccttctgtcccgtcatgcggctgcacggggaccgcgagccgcggcagccgaggctgggcgaaggcggcgggagcgggtgccggagcggtgcgccgaacgaggtgtggtcgtatggcgaggaggtctatgccatttgcgagaggtacttgcgggtgcgcgaggggctgagggcctatacgcgcgaggccatgcgggaagcgcatgaggagggcgatccggtcatgaggacgctgttttatgagttcccggacgatgccagggcgtgggaggtcgaggacgaatacttgttcgggccgaagtacctggtggcgccggtgctatatcccggcatcaagacccggaaggtgtacttccctaagggagcgacctggaaagcgttcgagggggatgcgaagtacgaaggaggaactactgcggaagtggacacgccgattgagtctatcccggtgttcgtcagggaatag

SEQ ID NO: 174 - protein, 674 aa, M. phaseolina
MFSQDGHRLIYRYDAETLWIEPWGPNAVRVRATKCSHMPADNWALDITPPALAAAPTIAIPRAGSGSANATLTNGAIRATLTPRGKLTLHNAHTQALLVAEYARNRLDVTDPQCSALEIAARDFAPVPGSDAYALTARFEGVARGEKLYGMGQYQHGLLDLAGADVELAQRNSQASVPFLVSSRGYGLLWNNPGVGRAVLGKNVRSFEAAATRALDYWVVAGDGAGPKAIERAYAGVTGKAPMMPEYGLGFWQCKLRYQTQEELLGVAREYRRRGLPIDVIVVDFFHWPRQGEWRFDPVFWPDPDAMVRELKELRIELMVSIWPTVDKRSEHYEEMVEHGYLIRTDRGIRTAMDFQGDTVHADFTNPGAREYVWKLVKKNYWDKGIRIFWCDEAEPHPAAEYTVYDFDNYRYHAGPNLQIGNLYPLHYAAAFHAGQHAAGQTQIVNLLRCAWASSQKYGALVWSGDIASSWPSLRAQLAAGLNMGLAGIPWWTTDIGGFHGGDPRDAAFRELFVRWFQWGAFCPVMRLHGDREPRQPRLGEGGGSGCRSGAPNEVWSYGEEVYAICERYLRVREGLRAYTREAMREAHEEGDPVMRTLFYEFPDDARAWEVEDEYLFGPKYLVAPVLYPGIKTRKVYFPKGATWKAFEGDAKYEGGTTAEVDTPIESIPVFVRE

SEQ ID NO: 175 - DNA, 2732 bp, M. phaseolina
ccgtctctgcttgcaatcccctgctattcaacggcgtgtcgtttccttaagctacgggtctgagctggcggaacccagggcacttcatgcaatttaaaacatcattaccgcctttgccggcaactagcggagtcctgacgacgtccaggcatgtggctcgtcgcggccgacaaacatgtgcagtatgcggaggacatctacaccgtcacacccagggatgacaaggctctcgacctcctgtgtcctacgaggcacatccggtcccgcggcgatacgctaaatctgagcaccatcaatgtcgagctcgaggcacagtttgacggggtcatctctattgaggctacccacttctctggagctcaaagaagggggccgaacttcgagctgttcccggatggaaggccagagcgcgggaagagtgagtgggtacgaactcgcctcacttgcagtttctgacgagattccagccggtataagcaaaggagagaagggaaccacactcacatcaggagcactctccgccacggtcgggccggacccgcatgcctttgacatccgcttccacgcgacggacgggtcgaaggagctcacgcagctgctgaaccgcagcgttggtcttgcgtacagccccgccaccagcaacccgaagcaggtggaggacatgcgcaacctgcagcattacgtcttcacgcagcacgagctcggggtgggcgagacgatccatgggctgggcgagcggttcggagcgtggaacaaggtaggccagacggtggagctctggaacgaggacggcgggacgtcgagcgaccaggcgtacaagaacatctccttctacctgagctccaagggctacggcgtcttcatcgacacgccggacagggtgtcgctcgagattggcagcgagcggtgctgccggctgcaggcgtcggtcgagggccaacggctcaagtggtacatcatctacgggcagtcgggccccaaggaggtgctgagcaagtactcgatgctgacggggcggccggggaagctgccggcatggagcttcgggctgtggctgtcgacgtcgttcacgaccgactacgacgagcggacggtgacgcacttcctggaggagatgcgggcgcggtcggtgccggtcgagacattccacttcgactgcttctggctgcgggccttccactggtgcgactttgtgttctcgtcggagcacttcccggatgcggcgggccagatcaggcggatgaaggagggcgggctggcgaacaaggtgtgcgtgtggatcaacccgtacctgggccaggcgtcgcccgtgttccggtacgcggcggagcggggctatctgctgaagcgcaagaacggcgatgtgtggcagtgggacctgtggcagacgggcatgggcatcgtcgacatcaccaacccggcggcgcgcgactggtacgtgggctgtctgaagcagctgttcgacctgggcgtcgacacgctgaagaccgactttggcgagcgcattcccgtcaccgacgtgcagtggcacgaccgcgacgtcgacccagcccgcatgcacaactactacgccttctggtataacaagctcgtctacgaggcactggagcaccgctacggcagcggcgaagccgtgttgttcgcgcgggccgccaccgccggcacccagcgcttccccctggtaagctggcccttttcctgaccactcccgcgtctgatccttcgccctgctgacccgcgcgcaccagtgctggggcggcgactgcgagtccacgcccgccgcgctggccgagtcggtccgcggcggcctgtcgctcggcctgtcgggcttcagcttctggtcctgcgacattggcggcttcgagggcaacccgccgccgtggatctacaagcgctgggtggccttcggtctgctgtgctcgcacagccgcctgcacggctccaactcctaccgcgtgccgtggctcatcgacggcggtgcgagcggcgagggcagcgcgaccagcgtgctgcgcacctttgtgcgcctcaagcgccgcctgatgccctacctgtacgcccaggcagagaccagccgccgcaacggctggccgctgtcgctgcgcgccatgtgcctcgagttccccgacgacccgaccagctggttcctcgacaggcagttcatggtcggcgacagcatcctcgccgcccccgtcttcaccgagcacggcgacgtcgacttctacctgcccgccggccgctggacctcgtggtgggatcccagcgccgtcatcgacggccctggctggcgtcgcgagaaacacggctttgagacgctgccgctgtacgtgcgcgagggcgccgtgcttgtcctgggccaggaagaggagggagtcaagggcgagggcttcgcgtacgactggctgcgccgcggagtcgacgtccgtttgtaccacaccaagggcggcgagtcggcagatgtcgtcgatgtccagggcgagtccgttgcaacgctgacggtcgcggacggcggcgcggacgtcgtcgatgccggcctgcagaagttgcgggccagaggcggcgtcgacgtccgctgcgtgtaactgtgcttttgctttattgttgcccttcctttcagctctgacattagcatgcaagggctattgctccgcagcattacaataaactagctgactgactgaatcagcatggcgcgtggctgaactcgtgtttgtgaatgatgagcggtcgca

SEQ ID NO: 176 - DNA, 2316 bp, M. phaseolina
atgtggctcgtcgcggccgacaaacatgtgcagtatgcggaggacatctacaccgtcacacccagggatgacaaggctctcgacctcctgtgtcctacgaggcacatccggtcccgcggcgatacgctaaatctgagcaccatcaatgtcgagctcgaggcacagtttgacggggtcatctctattgaggctacccacttctctggagctcaaagaagggggccgaacttcgagctgttcccggatggaaggccagagcgcgggaagaccggtataagcaaaggagagaagggaaccacactcacatcaggagcactctccgccacggtcgggccggacccgcatgcctttgacatccgcttccacgcgacggacgggtcgaaggagctcacgcagctgctgaaccgcagcgttggtcttgcgtacagccccgccaccagcaacccgaagcaggtggaggacatgcgcaacctgcagcattacgtcttcacgcagcacgagctcggggtgggcgagacgatccatgggctgggcgagcggttcggagcgtggaacaaggtaggccagacggtggagctctggaacgaggacggcgggacgtcgagcgaccaggcgtacaagaacatctccttctacctgagctccaagggctacggcgtcttcatcgacacgccggacagggtgtcgctcgagattggcagcgagcggtgctgccggctgcaggcgtcggtcgagggccaacggctcaagtggtacatcatctacgggcagtcgggccccaaggaggtgctgagcaagtactcgatgctgacggggcggccggggaagctgccggcatggagcttcgggctgtggctgtcgacgtcgttcacgaccgactacgacgagcggacggtgacgcacttcctggaggagatgcgggcgcggtcggtgccggtcgagacattccacttcgactgcttctggctgcgggccttccactggtgcgactttgtgttctcgtcggagcacttcccggatgcggcgggccagatcaggcggatgaaggagggcgggctggcgaacaaggtgtgcgtgtggatcaacccgtacctgggccaggcgtcgcccgtgttccggtacgcggcggagcggggctatctgctgaagcgcaagaacggcgatgtgtggcagtgggacctgtggcagacgggcatgggcatcgtcgacatcaccaacccggcggcgcgcgactggtacgtgggctgtctgaagcagctgttcgacctgggcgtcgacacgctgaagaccgactttggcgagcgcattcccgtcaccgacgtgcagtggcacgaccgcgacgtcgacccagcccgcatgcacaactactacgccttctggtataacaagctcgtctacgaggcactggagcaccgctacggcagcggcgaagccgtgttgttcgcgcgggccgccaccgccggcacccagcgcttccccctgtgctggggcggcgactgcgagtccacgcccgccgcgctggccgagtcggtccgcggcggcctgtcgctcggcctgtcgggcttcagcttctggtcctgcgacattggcggcttcgagggcaacccgccgccgtggatctacaagcgctgggtggccttcggtctgctgtgctcgcacagccgcctgcacggctccaactcctaccgcgtgccgtggctcatcgacggcggtgcgagcggcgagggcagcgcgaccagcgtgctgcgcacctttgtgcgcctcaagcgccgcctgatgccctacctgtacgcccaggcagagaccagccgccgcaacggctggccgctgtcgctgcgcgccatgtgcctcgagttccccgacgacccgaccagctggttcctcgacaggcagttcatggtcggcgacagcatcctcgccgcccccgtcttcaccgagcacggcgacgtcgacttctacctgcccgccggccgctggacctcgtggtgggatcccagcgccgtcatcgacggccctggctggcgtcgcgagaaacacggctttgagacgctgccgctgtacgtgcgcgagggcgccgtgcttgtcctgggccaggaagaggagggagtcaagggcgagggcttcgcgtacgactggctgcgccgcggagtcgacgtccgtttgtaccacaccaagggcggcgagtcggcagatgtcgtcgatgtccagggcgagtccgttgcaacgctgacggtcgcggacggcggcgcggacgtcgtcgatgccggcctgcagaagttgcgggccagaggcggcgtcgacgtccgctgcgtgtaa

SEQ ID NO: 177 - protein, 771 aa, M. phaseolina
MWLVAADKHVQYAEDIYTVTPRDDKALDLLCPTRHIRSRGDTLNLSTINVELEAQFDGVISIEATHFSGAQRRGPNFELFPDGRPERGKTGISKGEKGTTLTSGALSATVGPDPHAFDIRFHATDGSKELTQLLNRSVGLAYSPATSNPKQVEDMRNLQHYVFTQHELGVGETIHGLGERFGAWNKVGQTVELWNEDGGTSSDQAYKNISFYLSSKGYGVFIDTPDRVSLEIGSERCCRLQASVEGQRLKWYIIYGQSGPKEVLSKYSMLTGRPGKLPAWSFGLWLSTSFTTDYDERTVTHFLEEMRARSVPVETFHFDCFWLRAFHWCDFVFSSEHFPDAAGQIRRMKEGGLANKVCVWINPYLGQASPVFRYAAERGYLLKRKNGDVWQWDLWQTGMGIVDITNPAARDWYVGCLKQLFDLGVDTLKTDFGERIPVTDVQWHDRDVDPARMHNYYAFWYNKLVYEALEHRYGSGEAVLFARAATAGTQRFPLCWGGDCESTPAALAESVRGGLSLGLSGFSFWSCDIGGFEGNPPPWIYKRWVAFGLLCSHSRLHGSNSYRVPWLIDGGASGEGSATSVLRTFVRLKRRLMPYLYAQAETSRRNGWPLSLRAMCLEFPDDPTSWFLDRQFMVGDSILAAPVFTEHGDVDFYLPAGRWTSWWDPSAVIDGPGWRREKHGFETLPLYVREGAVLVLGQEEEGVKGEGFAYDWLRRGVDVRLYHTKGGESADVVDVQGESVATLTVADGGADVVDAGLQKLRARGGVDVRCV

SEQ ID NO: 178 - DNA, 1675 bp, M. phaseolina
tgcaacgatcaccagcggcccctgaccaccccataaaacaaatacaataacagccccggaggcgcgtctccgccgccgcactccgaatttccctgttgcgtcgttcccatcgcacccagcccaaaatcaccgcctgtccccacgcccaacatgcggctgcctaactgtcttctagcgccttctttacttggagctgcatgcttgttcgctcaacaggtcgtggctttcccgaatgccacgaaatactccacttggatggccgccagcatcataagtcgcgggcaaggagtccttactggccaaggcgattcttccgagctacttcaggcaggcttcacccagaaggcgttcagacagttgatccaacaatacccgaatgatccctcggccggcccgattgatgagtacatccagaaaagcgtcaattctgtcattaccaccgtgtccaacgccacggcagacacaggctatccgctcgacaggctctccaatggcaacaacctcattgtcaagtatgaggaaactggcaacgcgacttatcaggatgcctttgaggcgttgcggcaatctatcgatttgcaggcgcgaaatgcggagggaggtctgttttactatgtttacccgtattggtcgtacttggacggcatgttttcgctcgcgcccttttacacgctctacactaacctgtacgatgcggacaacacgaccgccgtcatggacgatgtaatccttcaactagacttgttgtggcagcactgccggagtaatgccactggcctgctcgtccacggctatgacgcatcgcgcacggccgtctgggccgatcctgtcactggcgcgagcccacatgtgtgggggagaagcttgggatggtctgtatcttcgatcgcttttgcgcttctgcactaattcgggcgataggtacatgatggcactgatcgatacgctcgaactggtccccgaaacggcgaaggaggcgcagcagtaccttcagacgcggttcagggagctcgcagatgcggtggtgcgcacagtcgacagaaccagcggtgcgtggtggcagctgctggaccagcccggccgcgagggtaactacatcgagagcagcggcagcgccatgttcgcctattccttgctcaaaggcgcgaggctggggtatctggaggacggacccaggagcaacacgagcggaaccgcagcgtggacggatgtggcaacccgagcgttcgagtacgtggtagacaagttcgtggtccgcaatgtaaatggcacgcttgggtacaatgggaccgtttccgtttgtagcctgaattcgaccgcttcgtacgaggtacgttcgccgaaccacccacagaactccctgactcgagtccgtgacctgggcttgtgaaaacgttacgctgatggaccttccttgcagtattatgttgggcgaccgatcctctacaatagcgttctcggaagtgctgcgttcatccttgcgtcgctggaatacgagagttttgtgggcgtaccaaaggattaggacggtggtgcggagaacgatgtcaagggtgtctgacgcgtcacatcacggagttgaacgtaatacggggtccgaaggggtctgctgtcttcgtattgtacgtctttcggacttgccgtctcagaaaggtcttccccaacaccgcgtatg

SEQ ID NO: 179 - DNA, 1236 bp, M. phaseolina
atgcggctgcctaactgtcttctagcgccttctttacttggagctgcatgcttgttcgctcaacaggtcgtggctttcccgaatgccacgaaatactccacttggatggccgccagcatcataagtcgcgggcaaggagtccttactggccaaggcgattcttccgagctacttcaggcaggcttcacccagaaggcgttcagacagttgatccaacaatacccgaatgatccctcggccggcccgattgatgagtacatccagaaaagcgtcaattctgtcattaccaccgtgtccaacgccacggcagacacaggctatccgctcgacaggctctccaatggcaacaacctcattgtcaagtatgaggaaactggcaacgcgacttatcaggatgcctttgaggcgttgcggcaatctatcgatttgcaggcgcgaaatgcggagggaggtctgttttactatgtttacccgtattggtcgtacttggacggcatgttttcgctcgcgcccttttacacgctctacactaacctgtacgatgcggacaacacgaccgccgtcatggacgatgtaatccttcaactagacttgttgtggcagcactgccggagtaatgccactggcctgctcgtccacggctatgacgcatcgcgcacggccgtctgggccgatcctgtcactggcgcgagcccacatgtgtgggggagaagcttgggatggtacatgatggcactgatcgatacgctcgaactggtccccgaaacggcgaaggaggcgcagcagtaccttcagacgcggttcagggagctcgcagatgcggtggtgcgcacagtcgacagaaccagcggtgcgtggtggcagctgctggaccagcccggccgcgagggtaactacatcgagagcagcggcagcgccatgttcgcctattccttgctcaaaggcgcgaggctggggtatctggaggacggacccaggagcaacacgagcggaaccgcagcgtggacggatgtggcaacccgagcgttcgagtacgtggtagacaagttcgtggtccgcaatgtaaatggcacgcttgggtacaatgggaccgtttccgtttgtagcctgaattcgaccgcttcgtacgagtattatgttgggcgaccgatcctctacaatagcgttctcggaagtgctgcgttcatccttgcgtcgctggaatacgagagttttgtgggcgtaccaaaggattag

SEQ ID NO: 180 - protein, 411 aa, M. phaseolina
MRLPNCLLAPSLLGAACLFAQQVVAFPNATKYSTWMAASIISRGQGVLTGQGDSSELLQAGFTQKAFRQLIQQYPNDPSAGPIDEYIQKSVNSVITTVSNATADTGYPLDRLSNGNNLIVKYEETGNATYQDAFEALRQSIDLQARNAEGGLFYYVYPYWSYLDGMFSLAPFYTLYTNLYDADNTTAVMDDVILQLDLLWQHCRSNATGLLVHGYDASRTAVWADPVTGASPHVWGRSLGWYMMALIDTLELVPETAKEAQQYLQTRFRELADAVVRTVDRTSGAWWQLLDQPGREGNYIESSGSAMFAYSLLKGARLGYLEDGPRSNTSGTAAWTDVATRAFEYVVDKFVVRNVNGTLGYNGTVSVCSLNSTASYEYYVGRPILYNSVLGSAAFILASLEYESFVGVPKD

SEQ ID NO: 181 - DNA, 1443 bp, M. phaseolina
gcgctcctaaacagccccagtagcccgccgtctggtctggagacgatagttagcacgcctgctgttgattgacgccagtcgcgccctcaccacccaccggagcctctctgcctcccgcctgcccggccccacctctccctcgccctcaccatgcccaccgccctctccgtccacgggctgcctgcccagacgatccacgacgccattgccaagctcaccgacaacctcgtcaacatcaacgaccagaccggccacttcctcctccgcctccccgacggccgcgtcatcgacaccaagggctggaacgactgggagtggacgcacggcatcggcctgtatggcctgtaccagtactacacgctcaccaactcgcagccgacgctggacatcatcaaggcgtggttcgcggggcggctggccgagggcacgaccaagaacatcaacaccatgtccgtcttcctgacgctggcctacctgtacgacgacgaccgcctgcgcgacgacacctggcggccgtggctcgagagctgggccgactgggccatgcacgacctgccgcgcacgcccttcggcggcttccagcacatcacctacctggaggaaaacgccggccagctgtgggacgacacgctgatgatgacggtcatgccgctggccaagatcggcctggtcctcaaccggcccgagtacgtcgaggaggcgaagcgccagttcctggtgcacatgcagttcctgttcgaccacgagtcgggcctgttcttccacggctggcagttcgagaagggcaaggcgggctctctggggcacaacttcgcgcgcgcgcggtgggcgcgcggcaactcgtgggtgacgatcgtgatccccgacttcatcgagctgctcgacctcaggccgggcgacccgacgcgcgagtacctgctcgacatcttccgcgcccaggtcgacgcgctccgtggcctgcagacgcccgacggcctgtggcggacgctgctcgacgagcccgagtccgccggcagctacgtcgagtcgtcggccacggccggcttcgcctacggcatcctcaaggctgtgcggaagcgctacgtcggccgcgagtacgaggacatggccatccgcgccaccaaggctgttctggccaagatcagccccgacggcgagctgctcgacaccagcttcggcaccggcatgggccgcgactacaagcactacttcgacatcgagcggacgagcatgccctacggccaggccatggccatcatgacgctcgtcgagttcctgaggttataccattgagcgcgggtaaaaaggaatgcgggcaagggaaatttgcggatcagcccgaatcgggcggcagtatttgtgcatagactatagatagggatgcgataacgggtaaccaaaaaaagggttatatcttggcaggatgcgaagttgaaaccgctt

SEQ ID NO: 182 - DNA, 1143 bp, M. phaseolina
atgcccaccgccctctccgtccacgggctgcctgcccagacgatccacgacgccattgccaagctcaccgacaacctcgtcaacatcaacgaccagaccggccacttcctcctccgcctccccgacggccgcgtcatcgacaccaagggctggaacgactgggagtggacgcacggcatcggcctgtatggcctgtaccagtactacacgctcaccaactcgcagccgacgctggacatcatcaaggcgtggttcgcggggcggctggccgagggcacgaccaagaacatcaacaccatgtccgtcttcctgacgctggcctacctgtacgacgacgaccgcctgcgcgacgacacctggcggccgtggctcgagagctgggccgactgggccatgcacgacctgccgcgcacgcccttcggcggcttccagcacatcacctacctggaggaaaacgccggccagctgtgggacgacacgctgatgatgacggtcatgccgctggccaagatcggcctggtcctcaaccggcccgagtacgtcgaggaggcgaagcgccagttcctggtgcacatgcagttcctgttcgaccacgagtcgggcctgttcttccacggctggcagttcgagaagggcaaggcgggctctctggggcacaacttcgcgcgcgcgcggtgggcgcgcggcaactcgtgggtgacgatcgtgatccccgacttcatcgagctgctcgacctcaggccgggcgacccgacgcgcgagtacctgctcgacatcttccgcgcccaggtcgacgcgctccgtggcctgcagacgcccgacggcctgtggcggacgctgctcgacgagcccgagtccgccggcagctacgtcgagtcgtcggccacggccggcttcgcctacggcatcctcaaggctgtgcggaagcgctacgtcggccgcgagtacgaggacatggccatccgcgccaccaaggctgttctggccaagatcagccccgacggcgagctgctcgacaccagcttcggcaccggcatgggccgcgactacaagcactacttcgacatcgagcggacgagcatgccctacggccaggccatggccatcatgacgctcgtcgagttcctgaggttataccattga

SEQ ID NO: 183 - protein, 380 aa, M. phaseolina
MPTALSVHGLPAQTIHDAIAKLTDNLVNINDQTGHFLLRLPDGRVIDTKGWNDWEWTHGIGLYGLYQYYTLTNSQPTLDIIKAWFAGRLAEGTTKNINTMSVFLTLAYLYDDDRLRDDTWRPWLESWADWAMHDLPRTPFGGFQHITYLEENAGQLWDDTLMMTVMPLAKIGLVLNRPEYVEEAKRQFLVHMQFLFDHESGLFFHGWQFEKGKAGSLGHNFARARWARGNSWVTIVIPDFIELLDLRPGDPTREYLLDIFRAQVDALRGLQTPDGLWRTLLDEPESAGSYVESSATAGFAYGILKAVRKRYVGREYEDMAIRATKAVLAKISPDGELLDTSFGTGMGRDYKHYFDIERTSMPYGQAMAIMTLVEFLRLYH

SEQ ID NO: 184 - DNA, 1608 bp, M. phaseolina
aatgtattgtgttcttggtatcatccttcggacagtttttctcaagagtacataaacgccgtgtgctgcgcaaagaatggcagcatctcaccagtctagatctattttctcaggtgtccatatagtctatcgcgccggtgctttcttatcatgaagtctttcctactcgcagctgctgcggtggccagtgccacactggcctccgcaaagatcaccttacccaacggctggttcaaaatcccacctgaccagaaaattaaggccgcaaagtttgacggcaagccgcggtacctgacatggatggccgactcgcaaatcaagcacggcgtggagccgaccttcgcctacaccgtctccgcttacctctcgggcatcaagctggcgtacgaccgcacgggcgacgagaagtactacgactacctcaagcggcacacggacatcgtgctgtacccggcgtggaacggcgagatcctgctgtacaacaacagcaactcgatcgacgacatccgcttcgggcacaccttccttgacctgtacaacctgacaggcggcgaggagatctacaggaaggccgcgcagacactgcgtaaccagattgaccgcacagggcgcacgcccgacggcggcttctaccaccgctacccggtctacatcgatcagatgtggctcgacggcatctacatgctcgacgtcttctacgcgcgctggacccacgagttcgagccggaaaacgccaccgcctgggacgacgtcgcgcggcagttcgacctcatcgacgcgggcaccaccgttgaccgtgagcgcacgggtggcctgcccctgcacggcttcgactacagcaagagcaccgtctgggcggatccggagacgggcgccgcgccgcatgtttggggccgcgcggtcggctggtacataatggcccttgtcgatacgctagattacttcccggagacgcatcccgggcgggagcgcctggtggggtacttgcggtcgctggcggatgccattgtcgcggcgcaggacgagcgtacgaagggctggtacaacatcatggatccgggcctcgaggagcggtcgggcaattacatcgagagctcagggtcagccatgttcgtgtacgggttgctgaagagcttgcggaacgggtacatccagggcgagaaatacctgaaggcagcgctcggtgggtataagttgatgactgagacgtttgcggaggagcggaagtcggatggctccttggcttggggatggactgtgcagacgggcagtctgagcagcaatggaaccttcgaggtgagtcatttgacgtactgctttactgtctttctttggaaatgctaatcgtctgtatagtattacgccagcataccactgtatgagaacgacttgaagggtgtttctcctttcttgttcgccagctatgagtatgaactatatgtcgagggaggaaaatgagggcgaaatgaaacatagggactctgaaagtgggcttgcggcgatatttcgagggactgaatgagtgaaatagagtgcggagtgaaataccttttttggcgagaattacctggtagccacaaggaaagactagattgaggcatactgcgc

SEQ ID NO: 185 - DNA, 1248 bp, M. phaseolina
atgaagtctttcctactcgcagctgctgcggtggccagtgccacactggcctccgcaaagatcaccttacccaacggctggttcaaaatcccacctgaccagaaaattaaggccgcaaagtttgacggcaagccgcggtacctgacatggatggccgactcgcaaatcaagcacggcgtggagccgaccttcgcctacaccgtctccgcttacctctcgggcatcaagctggcgtacgaccgcacgggcgacgagaagtactacgactacctcaagcggcacacggacatcgtgctgtacccggcgtggaacggcgagatcctgctgtacaacaacagcaactcgatcgacgacatccgcttcgggcacaccttccttgacctgtacaacctgacaggcggcgaggagatctacaggaaggccgcgcagacactgcgtaaccagattgaccgcacagggcgcacgcccgacggcggcttctaccaccgctacccggtctacatcgatcagatgtggctcgacggcatctacatgctcgacgtcttctacgcgcgctggacccacgagttcgagccggaaaacgccaccgcctgggacgacgtcgcgcggcagttcgacctcatcgacgcgggcaccaccgttgaccgtgagcgcacgggtggcctgcccctgcacggcttcgactacagcaagagcaccgtctgggcggatccggagacgggcgccgcgccgcatgtttggggccgcgcggtcggctggtacataatggcccttgtcgatacgctagattacttcccggagacgcatcccgggcgggagcgcctggtggggtacttgcggtcgctggcggatgccattgtcgcggcgcaggacgagcgtacgaagggctggtacaacatcatggatccgggcctcgaggagcggtcgggcaattacatcgagagctcagggtcagccatgttcgtgtacgggttgctgaagagcttgcggaacgggtacatccagggcgagaaatacctgaaggcagcgctcggtgggtataagttgatgactgagacgtttgcggaggagcggaagtcggatggctccttggcttggggatggactgtgcagacgggcagtctgagcagcaatggaaccttcgagtattacgccagcataccactgtatgagaacgacttgaagggtgtttctcctttcttgttcgccagctatgagtatgaactatatgtcgagggaggaaaatga

SEQ ID NO: 186 - protein, 415 aa, M. phaseolina
MKSFLLAAAAVASATLASAKITLPNGWFKIPPDQKIKAAKFDGKPRYLTWMADSQIKHGVEPTFAYTVSAYLSGIKLAYDRTGDEKYYDYLKRHTDIVLYPAWNGEILLYNNSNSIDDIRFGHTFLDLYNLTGGEEIYRKAAQTLRNQIDRTGRTPDGGFYHRYPVYIDQMWLDGIYMLDVFYARWTHEFEPENATAWDDVARQFDLIDAGTTVDRERTGGLPLHGFDYSKSTVWADPETGAAPHVWGRAVGWYIMALVDTLDYFPETHPGRERLVGYLRSLADAIVAAQDERTKGWYNIMDPGLEERSGNYIESSGSAMFVYGLLKSLRNGYIQGEKYLKAALGGYKLMTETFAEERKSDGSLAWGWTVQTGSLSSNGTFEYYASIPLYENDLKGVSPFLFASYEYELYVEGGK

SEQ ID NO: 187 - DNA, 1534 bp, M. phaseolina
catgtcccgcatcatgccagaatataaggctgccctggacggctgttttgtttcgtttctttcgtcactggagccctcctttccttccgttgcccctcgctcacttcccagcacaaacgcgggctcgacgcttgctccgattccgccgccatgaagctttcttcctttgccgccgccgcggcgctctccgcttccacggccgccgcccaggcccagcagaagtactcgacttggatggccgactccctcatcctcaagaacatcgcggcggacaaccactacacaaatgccgtcctctaccgcgggatcgacctcgtctacaaggcgtacggcaatgagtcgtactacacctgggtcaaggagcagctggaccagattgtcagcgacaacggcaccatcgcgacctaccccacggacaaggactcgctcgacgacatcctgctgggccgcgctctgctggagctgtacggccagaccaacgccaccaagtacaaggcggcggccggcctgcttcgcgagcagctcaacttccaggcgcgcacgcccgctggcggcttctggcaccgcgtgcccacgtaccccaaccagatgtggctggacggcatctacatggccgacgtcttctacgcgcagtggaccgccgcctttgagcccaccaacaccaccgcctgggacgacatcctgctgcagtacgagctgatcgagcagcacctgcgcaacaagacgtccaacctgctgtaccacggctacgacgagctgaagaaggccgtgtgggctgacccggtgacgggtgcctcgccccacgtctgggatcgtgctctgggctggtacgtcatggcgctcctggacgtgctcgactacttccccaaggaccacgccggccaccagaagctcatcgactggtacgtcgcgtgcgcggacggcattctcgctgcgcaggacgccgagaccggcggctggtggctggtcatggacgagccgtacccgggcatggctggcaactacatcgagagctccggcaccgccatgttcacctacggcctgctcaagggcgcgcgcatgggctacatcagcgacgagaagtacaccgccgctgcgaccaaggcatacgagctcatgaccactgagtacgctgttgccaacgctaccggcggcatgctgaactgggagggcaccgtcgaggtcggcagcttgagcggcaatgcttcctaccaggtgggtctccaattctccttcaccgctacatcctcatccttcgtgaatgatctgctaacacgcggcctgccttcagtactacatcggcgtcccgctcgccgagaacgacctgaagggcgctggtcccttcatctacgccgctctcgagtacgaggccttcacggcgtagagaggtgtatctggagtagctgtacataccgcaacgcttttatcatattcactgtccaaatatttcacgccgaacaaaaaaaagaaatggagacgcatttgccaatgaccatggcgggcccgtccgcgtgactgctgcccgaatgaccaa

SEQ ID NO: 188 - DNA, 1158 bp, M. phaseolina
atgaagctttcttcctttgccgccgccgcggcgctctccgcttccacggccgccgcccaggcccagcagaagtactcgacttggatggccgactccctcatcctcaagaacatcgcggcggacaaccactacacaaatgccgtcctctaccgcgggatcgacctcgtctacaaggcgtacggcaatgagtcgtactacacctgggtcaaggagcagctggaccagattgtcagcgacaacggcaccatcgcgacctaccccacggacaaggactcgctcgacgacatcctgctgggccgcgctctgctggagctgtacggccagaccaacgccaccaagtacaaggcggcggccggcctgcttcgcgagcagctcaacttccaggcgcgcacgcccgctggcggcttctggcaccgcgtgcccacgtaccccaaccagatgtggctggacggcatctacatggccgacgtcttctacgcgcagtggaccgccgcctttgagcccaccaacaccaccgcctgggacgacatcctgctgcagtacgagctgatcgagcagcacctgcgcaacaagacgtccaacctgctgtaccacggctacgacgagctgaagaaggccgtgtgggctgacccggtgacgggtgcctcgccccacgtctgggatcgtgctctgggctggtacgtcatggcgctcctggacgtgctcgactacttccccaaggaccacgccggccaccagaagctcatcgactggtacgtcgcgtgcgcggacggcattctcgctgcgcaggacgccgagaccggcggctggtggctggtcatggacgagccgtacccgggcatggctggcaactacatcgagagctccggcaccgccatgttcacctacggcctgctcaagggcgcgcgcatgggctacatcagcgacgagaagtacaccgccgctgcgaccaaggcatacgagctcatgaccactgagtacgctgttgccaacgctaccggcggcatgctgaactgggagggcaccgtcgaggtcggcagcttgagcggcaatgcttcctaccagtactacatcggcgtcccgctcgccgagaacgacctgaagggcgctggtcccttcatctacgccgctctcgagtacgaggccttcacggcgtag

SEQ ID NO: 189 - protein, 385 aa, M. phaseolina
MKLSSFAAAAALSASTAAAQAQQKYSTWMADSLILKNIAADNHYTNAVLYRGIDLVYKAYGNESYYTWVKEQLDQIVSDNGTIATYPTDKDSLDDILLGRALLELYGQTNATKYKAAAGLLREQLNFQARTPAGGFWHRVPTYPNQMWLDGIYMADVFYAQWTAAFEPTNTTAWDDILLQYELIEQHLRNKTSNLLYHGYDELKKAVWADPVTGASPHVWDRALGWYVMALLDVLDYFPKDHAGHQKLIDWYVACADGILAAQDAETGGWWLVMDEPYPGMAGNYIESSGTAMFTYGLLKGARMGYISDEKYTAAATKAYELMTTEYAVANATGGMLNWEGTVEVGSLSGNASYQYYIGVPLAENDLKGAGPFIYAALEYEAFTA

SEQ ID NO: 190 - DNA, 1542 bp, M. phaseolina
cgacgagccttcagcgcagccgtgcctctctggcctcgcaagagtcggtagctccggcgccaattcccaatcgggcaacttgatcttctccagacacaaaaccaacacttcccctccgcccagctgctccgtccccggccaaccgcaaccatgacctcggccttggtcgagagaatcatctcccaaggctaccgtctggcaagccacagctgggagtacggcaccttcgccgaagctctgctggagtggtacgatccctactacagcgtcttcggcaacaaccccttcccggatggcaagatccccgtcgccaacgtctccgacgtccgcgcattgacttacgtcaaacctcacatctccatcaattcgtctgctctggttgatggcaatggtacgttttctgtcatcagtgtcgtcctccagcctcctcccatttttatccgtccgacctcgctctatgcaactggcatcacacgcaccctgtatatccaccgaacccacactgaccgccgcccaccaggctccgccggcgaccccgcctctctgggcgttgccgccatcctgatcggccaaacgcaaccagcctacctcgccgccgccggccgccaagtcgagcaccttctcacgaccgtcccccgctggtccaacggcgccatctcgcaccgcgaagacgtcgctgagctctgggccgactcgatttacatggcgccgcccactctcgcctactacggcgttgcgacatccaacataaccctcctctccgaatccatcgcccagtgcaacgcctaccgcgacgtgctctccgtgcccgccgcctcctcctcctcctccgccgccgccgccggcctctggcaccatatcatcggcccgcaatcgcaagacctgggcatctggagcacgggcaacgcgtgggcagcggccggcatggcgcgcgtgctcgcgacggccaagaagtcgcccttcgcgcacgaactcgccccggccatcgcagagctcggcgcgaacatcaaagtcctcctcgacggcgccatggccgtcgacgcgcgcgagccggccgagccgctgctgcgcaactacctcaacgacacggcctggttcggcgagctgtcgggcaccacgctgctgacggccgtcgcgtaccgcatgctcagcctcgagcccggcacgtttgcggtcgagcgctacggcaagtgggccgatgagaagagggaggcggtgacggcgcggattggcgacgatggtctgctggcgcccgtcgtcaatccgctggactggtatgataccacgcccggcacccagtcgcccgaggcgcaggcgtttgccgtcttgatgtttgctgcacacaggagcttttgtcaggggggcgcttgcgagatgccagtctctgattgatgggagtgatggaagctcggatggcactcgctcatgagcgctccctttttatttatttatttttttttttctgagcgaatcatgagatatgttactgaattacagatatgaagttcttatatattgaattcaagacacgaaaagactgct

SEQ ID NO: 191 - DNA, 1113 bp, M. phaseolina
atgacctcggccttggtcgagagaatcatctcccaaggctaccgtctggcaagccacagctgggagtacggcaccttcgccgaagctctgctggagtggtacgatccctactacagcgtcttcggcaacaaccccttcccggatggcaagatccccgtcgccaacgtctccgacgtccgcgcattgacttacgtcaaacctcacatctccatcaattcgtctgctctggttgatggcaatggctccgccggcgaccccgcctctctgggcgttgccgccatcctgatcggccaaacgcaaccagcctacctcgccgccgccggccgccaagtcgagcaccttctcacgaccgtcccccgctggtccaacggcgccatctcgcaccgcgaagacgtcgctgagctctgggccgactcgatttacatggcgccgcccactctcgcctactacggcgttgcgacatccaacataaccctcctctccgaatccatcgcccagtgcaacgcctaccgcgacgtgctctccgtgcccgccgcctcctcctcctcctccgccgccgccgccggcctctggcaccatatcatcggcccgcaatcgcaagacctgggcatctggagcacgggcaacgcgtgggcagcggccggcatggcgcgcgtgctcgcgacggccaagaagtcgcccttcgcgcacgaactcgccccggccatcgcagagctcggcgcgaacatcaaagtcctcctcgacggcgccatggccgtcgacgcgcgcgagccggccgagccgctgctgcgcaactacctcaacgacacggcctggttcggcgagctgtcgggcaccacgctgctgacggccgtcgcgtaccgcatgctcagcctcgagcccggcacgtttgcggtcgagcgctacggcaagtgggccgatgagaagagggaggcggtgacggcgcggattggcgacgatggtctgctggcgcccgtcgtcaatccgctggactggtatgataccacgcccggcacccagtcgcccgaggcgcaggcgtttgccgtcttgatgtttgctgcacacaggagcttttgtcaggggggcgcttgcgagatgccagtctctgattga

SEQ ID NO: 192 - protein, 370 aa, M. phaseolina
MTSALVERIISQGYRLASHSWEYGTFAEALLEWYDPYYSVFGNNPFPDGKIPVANVSDVRALTYVKPHISINSSALVDGNGSAGDPASLGVAAILIGQTQPAYLAAAGRQVEHLLTTVPRWSNGAISHREDVAELWADSIYMAPPTLAYYGVATSNITLLSESIAQCNAYRDVLSVPAASSSSSAAAAGLWHHIIGPQSQDLGIWSTGNAWAAAGMARVLATAKKSPFAHELAPAIAELGANIKVLLDGAMAVDAREPAEPLLRNYLNDTAWFGELSGTTLLTAVAYRMLSLEPGTFAVERYGKWADEKREAVTARIGDDGLLAPVVNPLDWYDTTPGTQSPEAQAFAVLMFAAHRSFCQGGACEMPVSD

SEQ ID NO: 193 - DNA, 2042 bp, M. phaseolina
tcgtcggtgcgagcctgagccaccgccttcgctctcaacccgcccttttagtcgctttgtgcctcgcgctccgctccctctgaaacattctccatccgctgcttcttcgccgtttcgataccccatagcgcgcgccttcttcgcaccgtcatgcttgttcgcttctccctctccggcgcggccctgctgctatgcgccgacgccttcgtcatccccgccgttctggacagccagaagccgctggccggcaacgccctgtccgacctcgccgccaaagtccatgctctttccgaccaactcgccctccgacccaccaccaagtcgtccctggatacatggctggacaaggaggaggacatcgccgtggatcggttgctggccaacattgcgccgagcggcaggaatgcgcaacacgctgcgcctggcaccgttcttgccagtccatccaaggagcaccccaactactactaccaatgtgagttcctcgcgcgcgctttgctgtcgtcgtcgtcgctgacccgtgtgcgctcctaggggttcgtgatgccggtataaccatggccaccgtcgtggatctgtacctcgccgatccttcctcagagctcagcagaacggtgctgctgcccacgctcgaatcctatgcttccatctcccagaagatccaacagactcccaacccgtcgggcgacttctccttccccgacctcaacgggctcggcgagccgaagttcgaggccgatggctccgccttcacctccaactggggccgcccgcagcgcgacggccccgctctgaggtcgatcgcgctcatgaagttcatgcgcgcatacaacgagagcaaccctggcctgtgggaatccaggaccacgtcgaccaacgactggttcaccaagctgtacagcccggacctgcccgcgcgcagcatcatcaaggctgacctggaatacgtcgcgcgccactggcccgagtcgggcttcgacgtgtgggaggaggtccagggccggcacttcttcaccgccatggcacagctgcgcgcactgcgcgagggcgccgagctggctgcgctcttcaacgacgccggcgctgccgcctactaccgcgaccaggcggcgaagctggaagccatgatcgcatccgacttctgggacaagcggggcggctacctgcgcgccacgcgcggcggcgacgccgagttccagcgctccggcatggactgcagcgtcctgctcggcagcatccacggcaacgccctcgagcccgcgtcgcccgatgcgccgctcttcccgccccacgacgacaaggtgctcgtctcgctcatgaagcttgtgcaggaccagcgcgaccgcttccccatcaacgcccagcccgagagccccgaggccggcgacgactcctctttcgctgaaagcgacccattgcgccccgcgggcgtcggccgctaccccgaggatgcctacgacggctacgcctccccccaccccggcgccggcaacccgtggttcctgtgcacggctagcgtcgccgagatcctgttccgcaccagcgcgcacgtcaacgcgacgggcgtcgtcaccgtctcggagagcggctgggacttctggcgaggcctcgtttgcccgtcatcgtcgtcgtcgtcggacaaggactgcgccctctcgtgggagcgcaagcgctacacggccggtgacggcaccggcgtcgtcgagaaggcgcagctgcgcttgaaggccatcggcgatgggttcttggccgtcgtcaagaggcacgcgaagggcgatggtgcgctgagcgagcagttcgatcggtggaccgggtttgagcgcggagccgaggatttgacgtggagctacggcgcgtttttgcaggcggtgtgggcgaggcagaggttgtgagaggtgagtgaggctgtcgtgaggaacgtaggcggagaggctgtgcgcgggctgggtaagcgagaggaactttgagcgtcgcggcaggattggggaaattgctactttagcgagagtgcggtgttattttttccgttgggatggatcgga

SEQ ID NO: 194 - DNA, 1683 bp, M. phaseolina
atgcttgttcgcttctccctctccggcgcggccctgctgctatgcgccgacgccttcgtcatccccgccgttctggacagccagaagccgctggccggcaacgccctgtccgacctcgccgccaaagtccatgctctttccgaccaactcgccctccgacccaccaccaagtcgtccctggatacatggctggacaaggaggaggacatcgccgtggatcggttgctggccaacattgcgccgagcggcaggaatgcgcaacacgctgcgcctggcaccgttcttgccagtccatccaaggagcaccccaactactactaccaatgggttcgtgatgccggtataaccatggccaccgtcgtggatctgtacctcgccgatccttcctcagagctcagcagaacggtgctgctgcccacgctcgaatcctatgcttccatctcccagaagatccaacagactcccaacccgtcgggcgacttctccttccccgacctcaacgggctcggcgagccgaagttcgaggccgatggctccgccttcacctccaactggggccgcccgcagcgcgacggccccgctctgaggtcgatcgcgctcatgaagttcatgcgcgcatacaacgagagcaaccctggcctgtgggaatccaggaccacgtcgaccaacgactggttcaccaagctgtacagcccggacctgcccgcgcgcagcatcatcaaggctgacctggaatacgtcgcgcgccactggcccgagtcgggcttcgacgtgtgggaggaggtccagggccggcacttcttcaccgccatggcacagctgcgcgcactgcgcgagggcgccgagctggctgcgctcttcaacgacgccggcgctgccgcctactaccgcgaccaggcggcgaagctggaagccatgatcgcatccgacttctgggacaagcggggcggctacctgcgcgccacgcgcggcggcgacgccgagttccagcgctccggcatggactgcagcgtcctgctcggcagcatccacggcaacgccctcgagcccgcgtcgcccgatgcgccgctcttcccgccccacgacgacaaggtgctcgtctcgctcatgaagcttgtgcaggaccagcgcgaccgcttccccatcaacgcccagcccgagagccccgaggccggcgacgactcctctttcgctgaaagcgacccattgcgccccgcgggcgtcggccgctaccccgaggatgcctacgacggctacgcctccccccaccccggcgccggcaacccgtggttcctgtgcacggctagcgtcgccgagatcctgttccgcaccagcgcgcacgtcaacgcgacgggcgtcgtcaccgtctcggagagcggctgggacttctggcgaggcctcgtttgcccgtcatcgtcgtcgtcgtcggacaaggactgcgccctctcgtgggagcgcaagcgctacacggccggtgacggcaccggcgtcgtcgagaaggcgcagctgcgcttgaaggccatcggcgatgggttcttggccgtcgtcaagaggcacgcgaagggcgatggtgcgctgagcgagcagttcgatcggtggaccgggtttgagcgcggagccgaggatttgacgtggagctacggcgcgtttttgcaggcggtgtgggcgaggcagaggttgtga

SEQ ID NO: 195 - protein, 560 aa, M. phaseolina
MLVRFSLSGAALLLCADAFVIPAVLDSQKPLAGNALSDLAAKVHALSDQLALRPTTKSSLDTWLDKEEDIAVDRLLANIAPSGRNAQHAAPGTVLASPSKEHPNYYYQWVRDAGITMATVVDLYLADPSSELSRTVLLPTLESYASISQKIQQTPNPSGDFSFPDLNGLGEPKFEADGSAFTSNWGRPQRDGPALRSIALMKFMRAYNESNPGLWESRTTSTNDWFTKLYSPDLPARSIIKADLEYVARHWPESGFDVWEEVQGRHFFTAMAQLRALREGAELAALFNDAGAAAYYRDQAAKLEAMIASDFWDKRGGYLRATRGGDAEFQRSGMDCSVLLGSIHGNALEPASPDAPLFPPHDDKVLVSLMKLVQDQRDRFPINAQPESPEAGDDSSFAESDPLRPAGVGRYPEDAYDGYASPHPGAGNPWFLCTASVAEILFRTSAHVNATGVVTVSESGWDFWRGLVCPSSSSSSDKDCALSWERKRYTAGDGTGVVEKAQLRLKAIGDGFLAVVKRHAKGDGALSEQFDRWTGFERGAEDLTWSYGAFLQAVWARQRL

SEQ ID NO: 196 - DNA, 2679 bp, M. phaseolina
acacttgttggtgtcgtgactcgcaaatgccaatataaaagggggacgcactccgcgcaccaacaagaagccgtttgaaagacagcagcgcagaaccttttgcagccagcctccttctctgaccttgggtacttctggatacgctccacaatgctctttccctccaaggccctggccctcgtcggcctcttggtcggcgacgcccttgccatcccggccaccacgctgcggaagcgccagagcagcgtcgatacctttatttcgactgagagcccgatcgcatatgccggtgtgctcgccaacattggtgacgatggctcaaaggtcgccggcgctgcggccggcatcgtcgtagcgagtccgagcaagagtaaccctgattgtatgtactaatcccgctaatacctctgattcaacttgcttccgcttctgcggatgttctttcttttgccgccgttgggcaatggtgctgacggaatgatagatttctacacctggactcgcgatgcatcccttgtcttcaaggcgcttgttgaccacttcatcgccggcgattactccctgcaggacgagattgaggatttcatcatctcgcaagcgaagttgcagggcgtgtccaacccgtccggtgacctaagatctggtgctggtcttgtaagtgaagctttcgtgttctgccccgcatggccagccccaaattatccttgaggcccgcattctatggccaaactcgcggcacataagatgtgggagttttgcaagagcatcgcttctggtacatttgagacttcagatatcatgagcacctcaaccttgtagtcagcgattggctgtcgattttatcttcagctcttattacaacaaaccagtgcttgagaacctaacatttcgtgcgcagggcgagcccaagttcaatgttgatctgacccaattcaccggtgcttggggaaggccgcaaagagatggaccggccctccgcgccacctctatgattgcctacgctcactggttgatcaacaacggttacagcgacaccgctagagatgttgtgtggcccgtcattaggaacgatctgtcttacgtttctcaatactggaaccagaccggttttgacctttggtaataaattcccaatgccacgatctgacagatcaaaactcaatgctaacgcaatgacacagggaggaggttcaaggctcatcctttttcaccattgcggtctcgcaccgtgctttagtcgagggcagcaccctcgcttctgcgctcggccagagctgcagctactgtgactctcaggcacctcaaactctctgcttcctgcaaagcttctggacttccaacggcaactacgtcgtctccaacatcaacaccaacaacggccgaaccggaaaggatgccaactccatccttgcttccattcacacgttcgatcctgatgcgggttgtgatgacagtaccttccagccctgctctgcacgtgcactggcgaaccacaaggctgtgactgactctttccgctccatctataacatcaactccggcattgctcagggccgggctgttgctgtgggtagatatgctgaggatgtctattacaacggtaacccctggtaagcaaatcccctggaatcgatcagacacaacagtggctaacagttaaacaggtacctcaccactctcgctgctgccgagcagctctacgatgcgctctacacctggacccgcgagggcactataaccatcacctccgtctccctgcctttcttccgggatatctactcctccgcagcagtcggcacctacgcatccggcagcgccgcctacacctcaatcctcaatgccgtcaagacctacgccgacggctacgtctccgtcgtccagaagtacacgccctcttccggcgcgttagccgagcagtactcgcgcaacgatggctcgccgctgtcggccgccgacctgacctggtcctacgccgccttcctgacggccattgcgcgccgcaactcgatcgtgccggcttcgtggggcggcgagacggccaatgtcgtgcccggcagctgcgtcgctaccagcgcaatcggcacctacgcttcggcaaccaacaccgtcttccccacttcacaaactagcaacccgggcgccaccaccacccgtccccctaccagctcgaccacgacaaccagggtcaccagcagcaccaccaccacgacaactaaccctacatctgtcgccgtcaccttcaacgtcatcgccaccaccgtcttcggcgagaacatcttccttgctggcagcatcgctgcgctgggctcgtgggcccccgcatccgccaaggcccttagcgcggataagtatactagcagtaacaatttgtggtatgtgacggtcagcttggcccctgggactagcttccagtacaagtacattcgcaagagcagcagcggcgcgtacacctgggagagcgatccgaaccgctcgtacaccgtaccgagtggcgtggcgacggcgacgattagcgatacctggaggtagattatgtagaatggggagggttgtggactgagcgggtaggtgaatatgatccgagacgatgaggggttcgcttttggagattatgtcatgaatgtaatggggaaaagaaaaaccacggttgcttggagttgcatgccattgcttgtgaat

SEQ ID NO: 197 - DNA, 1917 bp, M. phaseolina
atgctctttccctccaaggccctggccctcgtcggcctcttggtcggcgacgcccttgccatcccggccaccacgctgcggaagcgccagagcagcgtcgatacctttatttcgactgagagcccgatcgcatatgccggtgtgctcgccaacattggtgacgatggctcaaaggtcgccggcgctgcggccggcatcgtcgtagcgagtccgagcaagagtaaccctgattatttctacacctggactcgcgatgcatcccttgtcttcaaggcgcttgttgaccacttcatcgccggcgattactccctgcaggacgagattgaggatttcatcatctcgcaagcgaagttgcagggcgtgtccaacccgtccggtgacctaagatctggtgctggtcttggcgagcccaagttcaatgttgatctgacccaattcaccggtgcttggggaaggccgcaaagagatggaccggccctccgcgccacctctatgattgcctacgctcactggttgatcaacaacggttacagcgacaccgctagagatgttgtgtggcccgtcattaggaacgatctgtcttacgtttctcaatactggaaccagaccggttttgacctttgggaggaggttcaaggctcatcctttttcaccattgcggtctcgcaccgtgctttagtcgagggcagcaccctcgcttctgcgctcggccagagctgcagctactgtgactctcaggcacctcaaactctctgcttcctgcaaagcttctggacttccaacggcaactacgtcgtctccaacatcaacaccaacaacggccgaaccggaaaggatgccaactccatccttgcttccattcacacgttcgatcctgatgcgggttgtgatgacagtaccttccagccctgctctgcacgtgcactggcgaaccacaaggctgtgactgactctttccgctccatctataacatcaactccggcattgctcagggccgggctgttgctgtgggtagatatgctgaggatgtctattacaacggtaacccctggtacctcaccactctcgctgctgccgagcagctctacgatgcgctctacacctggacccgcgagggcactataaccatcacctccgtctccctgcctttcttccgggatatctactcctccgcagcagtcggcacctacgcatccggcagcgccgcctacacctcaatcctcaatgccgtcaagacctacgccgacggctacgtctccgtcgtccagaagtacacgccctcttccggcgcgttagccgagcagtactcgcgcaacgatggctcgccgctgtcggccgccgacctgacctggtcctacgccgccttcctgacggccattgcgcgccgcaactcgatcgtgccggcttcgtggggcggcgagacggccaatgtcgtgcccggcagctgcgtcgctaccagcgcaatcggcacctacgcttcggcaaccaacaccgtcttccccacttcacaaactagcaacccgggcgccaccaccacccgtccccctaccagctcgaccacgacaaccagggtcaccagcagcaccaccaccacgacaactaaccctacatctgtcgccgtcaccttcaacgtcatcgccaccaccgtcttcggcgagaacatcttccttgctggcagcatcgctgcgctgggctcgtgggcccccgcatccgccaaggcccttagcgcggataagtatactagcagtaacaatttgtggtatgtgacggtcagcttggcccctgggactagcttccagtacaagtacattcgcaagagcagcagcggcgcgtacacctgggagagcgatccgaaccgctcgtacaccgtaccgagtggcgtggcgacggcgacgattagcgatacctggaggtag

SEQ ID NO: 198 - protein, 638 aa, M. phaseolina
MLFPSKALALVGLLVGDALAIPATTLRKRQSSVDTFISTESPIAYAGVLANIGDDGSKVAGAAAGIVVASPSKSNPDYFYTWTRDASLVFKALVDHFIAGDYSLQDEIEDFIISQAKLQGVSNPSGDLRSGAGLGEPKFNVDLTQFTGAWGRPQRDGPALRATSMIAYAHWLINNGYSDTARDVVWPVIRNDLSYVSQYWNQTGFDLWEEVQGSSFFTIAVSHRALVEGSTLASALGQSCSYCDSQAPQTLCFLQSFWTSNGNYVVSNINTNNGRTGKDANSILASIHTFDPDAGCDDSTFQPCSARALANHKAVTDSFRSIYNINSGIAQGRAVAVGRYAEDVYYNGNPWYLTTLAAAEQLYDALYTWTREGTITITSVSLPFFRDIYSSAAVGTYASGSAAYTSILNAVKTYADGYVSVVQKYTPSSGALAEQYSRNDGSPLSAADLTWSYAAFLTAIARRNSIVPASWGGETANVVPGSCVATSAIGTYASATNTVFPTSQTSNPGATTTRPPTSSTTTTRVTSSTTTTTTNPTSVAVTFNVIATTVFGENIFLAGSIAALGSWAPASAKALSADKYTSSNNLWYVTVSLAPGTSFQYKYIRKSSSGAYTWESDPNRSYTVPSGVATATISDTWR

SEQ ID NO: 199 - DNA, 3281 bp, M. phaseolina
ggctccgccatacccgcacgccgccgctgagcgcgtccgaccctcgccgacatctccgccgggacacagacctcgccagacgcggtggcgccacatccgtccatcccgctgaccgtccaaagccagggaaagagcaagagcgcagctgaaatgagcgtttccaagacagccgccctgctgtgcttggcgggcgttgggcaagcccggctgacggatttcgtcgaccctctcatcggcaccgtgggcccaacgccgggctccaccattgccggaggcaattcgttccccggagccgcgctgccgtggggaatggtcaaggccggcattgacaccagctacctcgggctcccggacggcctcgggaatgactgcaatgcaggatacagcccgattggcaacgtgactgccgtgagcatgacccacgtcagcggcagcggcggcgtcccgacatgtaagctgcaatgggcccgcgtgaaagagtgactgcagcattgacatgcgtgcccagacggcctgatctcgcagatgcccctcctcggccccttggacaacatcaacctgggcgacaacacgacctactggcaaaaccgctcgctcgccctggaatcggcctcggtcggcctcttcaccaccaccctcctcaacggcatcaagatcgaagtcacctcgagcaaccactccgccttcatccgctacaccttcccctccgacccttcgccaggcaacctctcctcgtccatgcccacgctctcccaagacgccgacgcctccgccgacgcccacgtcctcgtggacctcacccacgtcctccccgcctgggactgggacgcgcagtcgtactcccagaaatacctgcacggcgcgctcaccacccaccagtcggcctcgacccaccaaccctcgtacgccggcagcgcctcctacttcggcggctggtcgcagccggacatgcacacgctgcacttctgcggcaacttctccatccccgcgacctcgccgctcgtgccgtccaacgcgtacgcggcgcaggggcccggcggccgcgtcgacggcgccggcacgctgagctggccgtacaacccggccgtgccgccgctgtgggagcagcggcccgtggtccggtcgtacacggacgtgcggtcgtcggcgggcagcgggctggggctgggcgcgctgttcagctggacgcgcgacgcggccggccgcgccaacgccagcggcccggccgtggtcgaggcgaaggtgggcatctcgtacatctccgcggccaaggcgtgcgcgcacgtggccgacgagctgccggcgagcgtcgcgttcgaggaggtggtggagcaggcgcgggccgagtgggaggagcgcgtgctgggcgcggtgcagctggaggaggacggcagtgcggagaacggcaacgcgacgttgaagcggatgctgtacacgtcgctgtatcagacggggctgatgcccacagacaagactggtgagaatccgtggtgggagagcgatgaggagaagccgtatttcgatgatcactatgtgagtgctgtctcgattttttctttttctttttttttaggggggagggggggaggatatgagattggggatggatatgagattggggatggattgggagaggctttactgaccattcccccggcagacgctctgggacacgtatcgcaccacgctgcccctctaccacctcctcttcacctcgacctacacgcgcgtcctcaaaggcctcgtcaacatcttcaagtacgaaggctacctgcccgccggccgcaccgccaactggaacggccgcgtgcagggcggcacgcacgccgacaccgtcctcgccgacgccttcgccaagtccgtcatctccaaccgcacgcgcggccgcggcgagctggccctcagcgcctccgactggagcgacgcgtacgccgcgctcgtcaaggacgccgacgtgccgcccgcccgcaacgtcgacccggtcgcctttgacggcgcgaccaaggagggccgtggcgcgctcgacgaatacctcaccctgcactacctcacccgcaaccacacgcgcagcctcagccgcggcgtcgagtacccgcagaacgacttcgccgtgtggagcgtcgccagcgggctgcaggcgttgggcaacgagtcggtcgctgacgcagatgtggcgcggtaccgcgagcgcgcggggtggtggacggagcagtggaacccctcggcgaacacgacgctcgacggcgtcggcaccttcaccggcttcgtgggcgcgagggacgcagacggcgcgtggaatttctcgagctatgacccgaggagctgtggccgctgtgggtggggcagcgatatctacgaggcgaaggtgtgggagacgagcttctcggcggcgccgcacgatatggccaaggtggtggagctgatgggcggggatgacgcgttcttggctcgtctggacgcgtctttcttgcctggctttgggacgagtgtgggtgcgaataatgatgctggctcggcgctgttcaatcccggtaggttcgagacagcggcagaagggtgcacgaagcggtgactgacaaggacgcaggcaatgagccttcgtttgcgacgcctttcctgtacaactatgtgcctgggaacaactggaagacggtcaatcagtctcgtgccatcgtcgatgccttctacagcgacgccagaaacggttatcccggaaacatcgacagcggcgcgctgccgtcctggctcatcttcaatctgatcgggctggtaagtgcatcaccgactactcctatgcgcgaggccactagttcgaaagagaatctgacgtgtccccgtagtatcccattgctggtcagcctctctatctccttggcgcccctcgcttttcgtctctgaccctgcgcctattccctggcacggagcagatgacgtcgctgcaagtcaaggccaccaacctgtctgctacgaccttctacccccaacgcgtgacgcttaatggcgctgcacttgatcgggcgtggttgcaccattcggagctggttgatggcggagagctggttttcgagatgggcgctgagcctgcgaagtgggataccggggagaggccgtggtcgctgagcccatggtgaagggaacaaatgaagaaaagatacgtaattcacatgggcggagatccgtcctccttgccacgtgacccgctttggaacgcgtttggtaatgcagggtcctcagtggccgctatgtacatttaccacacgaattaatcaaccacttatccc

SEQ ID NO: 200 - DNA, 2670 bp, M. phaseolina
atgagcgtttccaagacagccgccctgctgtgcttggcgggcgttgggcaagcccggctgacggatttcgtcgaccctctcatcggcaccgtgggcccaacgccgggctccaccattgccggaggcaattcgttccccggagccgcgctgccgtggggaatggtcaaggccggcattgacaccagctacctcgggctcccggacggcctcgggaatgactgcaatgcaggatacagcccgattggcaacgtgactgccgtgagcatgacccacgtcagcggcagcggcggcgtcccgacatacggcctgatctcgcagatgcccctcctcggccccttggacaacatcaacctgggcgacaacacgacctactggcaaaaccgctcgctcgccctggaatcggcctcggtcggcctcttcaccaccaccctcctcaacggcatcaagatcgaagtcacctcgagcaaccactccgccttcatccgctacaccttcccctccgacccttcgccaggcaacctctcctcgtccatgcccacgctctcccaagacgccgacgcctccgccgacgcccacgtcctcgtggacctcacccacgtcctccccgcctgggactgggacgcgcagtcgtactcccagaaatacctgcacggcgcgctcaccacccaccagtcggcctcgacccaccaaccctcgtacgccggcagcgcctcctacttcggcggctggtcgcagccggacatgcacacgctgcacttctgcggcaacttctccatccccgcgacctcgccgctcgtgccgtccaacgcgtacgcggcgcaggggcccggcggccgcgtcgacggcgccggcacgctgagctggccgtacaacccggccgtgccgccgctgtgggagcagcggcccgtggtccggtcgtacacggacgtgcggtcgtcggcgggcagcgggctggggctgggcgcgctgttcagctggacgcgcgacgcggccggccgcgccaacgccagcggcccggccgtggtcgaggcgaaggtgggcatctcgtacatctccgcggccaaggcgtgcgcgcacgtggccgacgagctgccggcgagcgtcgcgttcgaggaggtggtggagcaggcgcgggccgagtgggaggagcgcgtgctgggcgcggtgcagctggaggaggacggcagtgcggagaacggcaacgcgacgttgaagcggatgctgtacacgtcgctgtatcagacggggctgatgcccacagacaagactggtgagaatccgtggtgggagagcgatgaggagaagccgtatttcgatgatcactatacgctctgggacacgtatcgcaccacgctgcccctctaccacctcctcttcacctcgacctacacgcgcgtcctcaaaggcctcgtcaacatcttcaagtacgaaggctacctgcccgccggccgcaccgccaactggaacggccgcgtgcagggcggcacgcacgccgacaccgtcctcgccgacgccttcgccaagtccgtcatctccaaccgcacgcgcggccgcggcgagctggccctcagcgcctccgactggagcgacgcgtacgccgcgctcgtcaaggacgccgacgtgccgcccgcccgcaacgtcgacccggtcgcctttgacggcgcgaccaaggagggccgtggcgcgctcgacgaatacctcaccctgcactacctcacccgcaaccacacgcgcagcctcagccgcggcgtcgagtacccgcagaacgacttcgccgtgtggagcgtcgccagcgggctgcaggcgttgggcaacgagtcggtcgctgacgcagatgtggcgcggtaccgcgagcgcgcggggtggtggacggagcagtggaacccctcggcgaacacgacgctcgacggcgtcggcaccttcaccggcttcgtgggcgcgagggacgcagacggcgcgtggaatttctcgagctatgacccgaggagctgtggccgctgtgggtggggcagcgatatctacgaggcgaaggtgtgggagacgagcttctcggcggcgccgcacgatatggccaaggtggtggagctgatgggcggggatgacgcgttcttggctcgtctggacgcgtctttcttgcctggctttgggacgagtgtgggtgcgaataatgatgctggctcggcgctgttcaatcccggcaatgagccttcgtttgcgacgcctttcctgtacaactatgtgcctgggaacaactggaagacggtcaatcagtctcgtgccatcgtcgatgccttctacagcgacgccagaaacggttatcccggaaacatcgacagcggcgcgctgccgtcctggctcatcttcaatctgatcgggctgtatcccattgctggtcagcctctctatctccttggcgcccctcgcttttcgtctctgaccctgcgcctattccctggcacggagcagatgacgtcgctgcaagtcaaggccaccaacctgtctgctacgaccttctacccccaacgcgtgacgcttaatggcgctgcacttgatcgggcgtggttgcaccattcggagctggttgatggcggagagctggttttcgagatgggcgctgagcctgcgaagtgggataccggggagaggccgtggtcgctgagcccatggtga

SEQ ID NO: 201 - protein, 889 aa, M. phaseolina
MSVSKTAALLCLAGVGQARLTDFVDPLIGTVGPTPGSTIAGGNSFPGAALPWGMVKAGIDTSYLGLPDGLGNDCNAGYSPIGNVTAVSMTHVSGSGGVPTYGLISQMPLLGPLDNINLGDNTTYWQNRSLALESASVGLFTTTLLNGIKIEVTSSNHSAFIRYTFPSDPSPGNLSSSMPTLSQDADASADAHVLVDLTHVLPAWDWDAQSYSQKYLHGALTTHQSASTHQPSYAGSASYFGGWSQPDMHTLHFCGNFSIPATSPLVPSNAYAAQGPGGRVDGAGTLSWPYNPAVPPLWEQRPVVRSYTDVRSSAGSGLGLGALFSWTRDAAGRANASGPAVVEAKVGISYISAAKACAHVADELPASVAFEEVVEQARAEWEERVLGAVQLEEDGSAENGNATLKRMLYTSLYQTGLMPTDKTGENPWWESDEEKPYFDDHYTLWDTYRTTLPLYHLLFTSTYTRVLKGLVNIFKYEGYLPAGRTANWNGRVQGGTHADTVLADAFAKSVISNRTRGRGELALSASDWSDAYAALVKDADVPPARNVDPVAFDGATKEGRGALDEYLTLHYLTRNHTRSLSRGVEYPQNDFAVWSVASGLQALGNESVADADVARYRERAGWWTEQWNPSANTTLDGVGTFTGFVGARDADGAWNFSSYDPRSCGRCGWGSDIYEAKVWETSFSAAPHDMAKVVELMGGDDAFLARLDASFLPGFGTSVGANNDAGSALFNPGNEPSFATPFLYNYVPGNNWKTVNQSRAIVDAFYSDARNGYPGNIDSGALPSWLIFNLIGLYPIAGQPLYLLGAPRFSSLTLRLFPGTEQMTSLQVKATNLSATTFYPQRVTLNGAALDRAWLHHSELVDGGELVFEMGAEPAKWDTGERPWSLSPW

SEQ ID NO: 202 - DNA, 3322 bp, M. phaseolina
ccatgcgaattggctcttaagcttataagcaagggacttcggacggaataaattgaaccgactaccggattgaaaggtctagctggctttttgctccgagaaaaatcctatggttgaatttgccacgacgcgaattgatcgtcagtcaagatgagaacaagcccaccttgcctctcattgcttttagttctcctcgcaaagatagcaaatactcaggatgacctggccgcctacgtcgaccccatgatcggtacctccggcactgttcccggcaccgcctacaacgccgggaacgtcttccccggcgctgccgtcccctttggggcagtgaaatgcggaatagagtaagcgtggtgttcacctttcatctctctctctctctctcgctcgctcgcttcaacaaaaaagcccctctaggcaattactaaaaacctcaccagcacaaccgtgtgagtctaaccaaccgctcttgtctgaaccacctcgaccacgcagttcaagacaattgaccgcaaaacgggcacaccagtttcaacaacagcttcaacgccaacggtggctacacgcccgacggcaacgttacagccatctcgcttctgcacgagagcggcaccggcggtgcggtcaagtacggcgtcgtggcgcagatgccgctggcgtcgctggccggcgtgaacgtactcgataacttgacgtacgcgcagcggcgggtcgggcaggatgaggcgagtccggggtacttcaagacggagctggggaacgtgagtaaactttctttcttttctttccctctcttgttatgacgcatgggtccaagataatgagtttgcggcgattatagggcgtgacggcggagatgtcggcaacgcagcatgtgggggtcatgaaatacagctaccagacagagggggagaggtatgtgctggtggatgtatcgcattacctcccgacgaacgacgaggtggcgttcgcgcagttctacagcaacggacgcctggatctggaagaggatgggtcgtacagcgggtacggggtgtggaggtaaagtcttatcgtcctgaaatacaaacacctccattaacacgaaaacccaggggcggctggaacggtggtcagcaatcccattcgctccacgatcccacgcgagggcaacatcaccctgacatttcctcaaacagatcccaactaccaagtccacttttgcggccgcttcgacaccgccccgaccacggccaccctcttctccggcccctacacagaccccttctggcccaacagcaccgccaccggcgacgccgtcgtccccacttggcacaacgcttccacctccctcgccggcggcccgcccggctacagcaccgccaaccgcatcggcgcgctcttcgccttcccgcccaacaccaccacgctcacctccaaagtcggcgtttcctggatctccgtcgccaaagcgtgccagtttgccgacgaggaggtcgtgtcctgggacctcggcgcgaccgcgcaagccgcgcgcgcgatgtggaacgacgacgtgctggcgcggatcaagacgggcgacagggcgaacgcgacgaggctgacgatgctgtattcggcgctttacaaggcgcatctgattccgaggtgagtgaggggattcgttttgttggtgccgcagagggttgcgaggtcggcgttgacggcggagtagcgaccgcaccggcgagaatccgcactggacgtcggaggagccgtattatgacgacttctacacgctttgggatactttcaggtgcttgaatagtctgtggttgctgctcgagccggcgagggcggcggggatggtgcgctcgttggtggatatttggagacatgagcgatttatgccggatgggcgcagtagtaactacaacggcagggtgagtgtatcactgcagacaattggatggacgttaacaggatcccccaggtacaagggggcagcaacgcggacaacgtcctcgcggacgcgttcgtcaaagggctcgagtacggaatcaactggacggacgcgtatgccgccatgaagactgatgcagaagtggtgccgtataacacgttcgatacggaggacccgacgcagagcacgaaggagggccgcggtgcgctgcgagactggctggactacggtttcgtgacgccgaactacggacgctccgtcagcaagacggtcgagtacgcactgaacgactttgctctcagccaggtagcaaaagacctcgcgccagacgactacccgaagtacttgcagcgatcagcgtaagttccctcccagcacccaggtcggctacatcatggcgttttgttaaataacacaacaccccatcgcagcggctggcaaaagatctggtccgccaacaccacctccctcaaccacaccgggtttcttgcgccactcttccccaacaacagcatcccggcctccctccaaccctacgaccccaccacttgcggcggctgcgaatggtcctccatcgcctacgaagccacgccgtgggaatacagctggacgatcccgttcgacatgcagacgcttatcacgctcatgggcgacgccgccgccgccgaggaccggctcgacaccatgttcgtgccgggcttgcggccggggtcggtggggtcgggcggctcgaacacgaacggcgacgcgctgttcaacccgggcaacgagccgagcttcaccacgccattcttgtacaactacttcgcacggcgccagcaccgcagcgtgttgcgcgcgcggcaggtcgtcaaccagtactacggcgtctcgccgtcgggcctgccggggaatagcgatggcggggcgctggatagctggttggtgtggaatctgctcgggctgtatccggtggtgacgcagccggtgtacctcatcttgtcgccgtggtttgcggatctgacgattcggatgccgagtccggaggggccggagggggtggacaggtggttaaatgtgacggccgaggggctgggggaggagagtttctacgtgcagagcctgaaggtgaatggggtgagttgggataagagttggctgagccacgaggatatcaaggccggggcgacgctagagttcgtgctgggcgcagagccggtggaatgggacacgggcgagttaccgcccagcccgggccatgtcgagctgtgagcgcggaactggatggctttcggtcgagcaagttttcccagcggaaggtaaaaggcgtggctgaagggtgacgaggctcagttgaaggcagtttcgatctgttgagtttgaggcgtggcggcttggttgcccgttggtcacccgatggtt

SEQ ID NO: 203 - DNA, 2361 bp, M. phaseolina
atgagaacaagcccaccttgcctctcattgcttttagttctcctcgcaaagatagcaaatactcaggatgacctggccgcctacgtcgaccccatgatcggtacctccggcactgttcccggcaccgcctacaacgccgggaacgtcttccccggcgctgccgtcccctttggggcagtgaaatgcggaatagacacaaccgttttcaacaacagcttcaacgccaacggtggctacacgcccgacggcaacgttacagccatctcgcttctgcacgagagcggcaccggcggtgcggtcaagtacggcgtcgtggcgcagatgccgctggcgtcgctggccggcgtgaacgtactcgataacttgacgtacgcgcagcggcgggtcgggcaggatgaggcgagtccggggtacttcaagacggagctggggaacggcgtgacggcggagatgtcggcaacgcagcatgtgggggtcatgaaatacagctaccagacagagggggagaggtatgtgctggtggatgtatcgcattacctcccgacgaacgacgaggtggcgttcgcgcagttctacagcaacggacgcctggatctggaagaggatgggtcgtacagcgggggcggctggaacggtgatcccaactaccaagtccacttttgcggccgcttcgacaccgccccgaccacggccaccctcttctccggcccctacacagaccccttctggcccaacagcaccgccaccggcgacgccgtcgtccccacttggcacaacgcttccacctccctcgccggcggcccgcccggctacagcaccgccaaccgcatcggcgcgctcttcgccttcccgcccaacaccaccacgctcacctccaaagtcggcgtttcctggatctccgtcgccaaagcgtgccagtttgccgacgaggaggtcgtgtcctgggacctcggcgcgaccgcgcaagccgcgcgcgcgatgtggaacgacgacgtgctggcgcggatcaagacgggcgacagggcgaacgcgacgaggctgacgatgctgtattcggcgctttacaaggcgcatctgattccgagcgaccgcaccggcgagaatccgcactggacgtcggaggagccgtattatgacgacttctacacgctttgggatactttcaggtgcttgaatagtctgtggttgctgctcgagccggcgagggcggcggggatggtgcgctcgttggtggatatttggagacatgagcgatttatgccggatgggcgcagtagtaactacaacggcagggtacaagggggcagcaacgcggacaacgtcctcgcggacgcgttcgtcaaagggctcgagtacggaatcaactggacggacgcgtatgccgccatgaagactgatgcagaagtggtgccgtataacacgttcgatacggaggacccgacgcagagcacgaaggagggccgcggtgcgctgcgagactggctggactacggtttcgtgacgccgaactacggacgctccgtcagcaagacggtcgagtacgcactgaacgactttgctctcagccaggtagcaaaagacctcgcgccagacgactacccgaagtacttgcagcgatcagccatcccggcctccctccaaccctacgaccccaccacttgcggcggctgcgaatggtcctccatcgcctacgaagccacgccgtgggaatacagctggacgatcccgttcgacatgcagacgcttatcacgctcatgggcgacgccgccgccgccgaggaccggctcgacaccatgttcgtgccgggcttgcggccggggtcggtggggtcgggcggctcgaacacgaacggcgacgcgctgttcaacccgggcaacgagccgagcttcaccacgccattcttgtacaactacttcgcacggcgccagcaccgcagcgtgttgcgcgcgcggcaggtcgtcaaccagtactacggcgtctcgccgtcgggcctgccggggaatagcgatggcggggcgctggatagctggttggtgtggaatctgctcgggctgtatccggtggtgacgcagccggtgtacctcatcttgtcgccgtggtttgcggatctgacgattcggatgccgagtccggaggggccggagggggtggacaggtggttaaatgtgacggccgaggggctgggggaggagagtttctacgtgcagagcctgaaggtgaatggggtgagttgggataagagttggctgagccacgaggatatcaaggccggggcgacgctagagttcgtgctgggcgcagagccggtggaatgggacacgggcgagttaccgcccagcccgggccatgtcgagctgtga

SEQ ID NO: 204 - protein, 786 aa, M. phaseolina
MRTSPPCLSLLLVLLAKIANTQDDLAAYVDPMIGTSGTVPGTAYNAGNVFPGAAVPFGAVKCGIDTTVFNNSFNANGGYTPDGNVTAISLLHESGTGGAVKYGVVAQMPLASLAGVNVLDNLTYAQRRVGQDEASPGYFKTELGNGVTAEMSATQHVGVMKYSYQTEGERYVLVDVSHYLPTNDEVAFAQFYSNGRLDLEEDGSYSGGGWNGDPNYQVHFCGRFDTAPTTATLFSGPYTDPFWPNSTATGDAVVPTWHNASTSLAGGPPGYSTANRIGALFAFPPNTTTLTSKVGVSWISVAKACQFADEEVVSWDLGATAQAARAMWNDDVLARIKTGDRANATRLTMLYSALYKAHLIPSDRTGENPHWTSEEPYYDDFYTLWDTFRCLNSLWLLLEPARAAGMVRSLVDIWRHERFMPDGRSSNYNGRVQGGSNADNVLADAFVKGLEYGINWTDAYAAMKTDAEVVPYNTFDTEDPTQSTKEGRGALRDWLDYGFVTPNYGRSVSKTVEYALNDFALSQVAKDLAPDDYPKYLQRSAIPASLQPYDPTTCGGCEWSSIAYEATPWEYSWTIPFDMQTLITLMGDAAAAEDRLDTMFVPGLRPGSVGSGGSNTNGDALFNPGNEPSFTTPFLYNYFARRQHRSVLRARQVVNQYYGVSPSGLPGNSDGGALDSWLVWNLLGLYPVVTQPVYLILSPWFADLTIRMPSPEGPEGVDRWLNVTAEGLGEESFYVQSLKVNGVSWDKSWLSHEDIKAGATLEFVLGAEPVEWDTGELPPSPGHVEL

SEQ ID NO: 205 - DNA, 2921 bp, M. phaseolina
ctccttccgttttgggccgggagcgtgcggggcagcaagatttacctcccggctcagccaagcgtagcatgactgtcgcacagatgtcaccctcatcaaacgcgtgaaacaaaatggtcttgtgcgcccggcttcttggccgcctctcgaatgaacgccatgttcggcttcctcattgcactcgcttgcgccgcctcgcctatcgctgctcaggcgggcggcgatttcgacatcttggattttgtggatccgctaattgggtcgaatggcggagggaacgtcttctgtggcgcaactctgccgtatgggttggtgcgttgtaccacctccctgtgctatgggcaggacatcaccatgcacgtggtgtccggcaacttcccaagcatcgcttcgcctggctctgtgctctgtgcgtgtcccgctaaacggctgagatacaggcaaaagcatctgccgatgtcgatggccagaacacagccggcttctcgacagatggcagcaatgtcatcggcttttcgagcttgcacgactctggaaccggcggcaatccatccctaggcaactttcccctgatgccgcagttgtgcgcggaaaatgacattaacaactgctccttctccaagcaagcgcgcgccacgccttaccgcaacgattccatcgtggccaggcccgggtattttgcgttgactctggacaacggcataagcgcagaaatgaccgtatcccagcacgctgcgttgcataatttcaaattcccagacgtcaacgccagcgacggcacgcaactggtccccatggtcctgctggatctcacggatctgtgggacagtcgccagaatggaaccttccaggcgcaagggaccaggatgaccggaaacgggacgtttctgccgagctttggagcgggatcctacgaagtgcacttctgtgtggatttcttcggccacaccggccccgtctacgacagtggcatctgggtcaacgaaaggggcggttcggatcaaaaggagatattcgtcaccaggggtttcaacaacttctatctccaagctggcggatttgtgcggctcctcgcagaagccaacagaaccatcaccgcgagggtgggcttgagctatatcagcgcccagaaggcgtgccggaacgcagaggcggagattccaagcccgctgtcggatttcaatcgtcttagagcagctgccgaggatgcttggagggacaaactgagcccgataaccctagacgccggtgaggtcagccaggacttgcagaagaacttctggagctcgatttacaggacaatgatctcaccccaggactatacgggcgagaatccacgctggaacacgtcagtttatttcgactcgttctattgcctgtgggaccagttcaggtctcagctgcccctgctcaccattctggatccgacggcttattcagacatgctgaacagtctcctgttcatctaccagaatgagggttggctgccggattgccggatgagtttaagcaagggctggactcagggaggctcgaatgcagatgtggtactggtggatgcttatttcaagaacgtcaccggtgtggactgggaccttgcctggaaggccgttgtgaatgatgcagaaaatgagccgctggaatggtcaaaggaaggtagaggaggcctgctgtcctggaagaacctccactatattccggcccttgattttgactatcttggtttcgggactaactcgagaagcatctcacgcaccttggaatacgcttacaacgattattgcatcggagcgcttggaagagcactggccaaggatggatatgagacgtatttggcccggggcaacaactggaagaacctcttcaaagaggatcaaacttcgattatcaacggcacagattcaggcttcgtcggcttcttccaacccaagtacctgaacgcaacttggggtttccaggatccgatctcgtgcagccctgtggcggggttctgttccctgacaagcaacccttcggagacgtttgaatcaagtatctgggagtatcagttgtaagtctcgagcggagaacaagtgcggaactgcaaccttactgatactgctccaagtttcgtaccccaagacatggaaacgctcattgcaagacttggtggagatcaaagatttgtcgaccggctggactatttccacgagtcgcccctcgtagatataggaaatgagccggtgttcttgagcgtcttcgaataccattacgcagggaggcctgccctttcagcacgacgctctcattcttacatcccgtctcgcttcaacacttcctacagtggcctaccaggaaatgatgatgtgagtaccgtgaatctgggtgagctacatatgtttgaactgacgcgttcccagagtggcgcaatgggttcttatgcagctttcaacatgatgggcctctttcccaaccctggccagaacgtctactttattattccgccgtatttcccgagaatgcaagtgcggcatccagtaacgaatcggacggcgacgatacgtgcggataatttcgacgccgcttacagcaacatctacatccagaatgcgacgctgaatggagagccgtacaccaaaaactggattgggcatgagttcttcacgcagggcggcgagctggtcctgaccctaggtagcgaggagagccagtggggaacagctgtagaggatcgaccgccttcggagactggaggaagtcggactgaggagcggtcttggagcggcctttagtagggcggcgaccgctgcgcaaacagcctgacaatgaaggcgatgattcagcttctgtttcattggactccatcaggcgtggactgaagtcacttgctggccaagttccgtagctgatccattgggacttgagtcgcaatccacacggcg

SEQ ID NO: 206 - DNA, 2382 bp, M. phaseolina
atgaacgccatgttcggcttcctcattgcactcgcttgcgccgcctcgcctatcgctgctcaggcgggcggcgatttcgacatcttggattttgtggatccgctaattgggtcgaatggcggagggaacgtcttctgtggcgcaactctgccgtatgggttggcaaaagcatctgccgatgtcgatggccagaacacagccggcttctcgacagatggcagcaatgtcatcggcttttcgagcttgcacgactctggaaccggcggcaatccatccctaggcaactttcccctgatgccgcagttgtgcgcggaaaatgacattaacaactgctccttctccaagcaagcgcgcgccacgccttaccgcaacgattccatcgtggccaggcccgggtattttgcgttgactctggacaacggcataagcgcagaaatgaccgtatcccagcacgctgcgttgcataatttcaaattcccagacgtcaacgccagcgacggcacgcaactggtccccatggtcctgctggatctcacggatctgtgggacagtcgccagaatggaaccttccaggcgcaagggaccaggatgaccggaaacgggacgtttctgccgagctttggagcgggatcctacgaagtgcacttctgtgtggatttcttcggccacaccggccccgtctacgacagtggcatctgggtcaacgaaaggggcggttcggatcaaaaggagatattcgtcaccaggggtttcaacaacttctatctccaagctggcggatttgtgcggctcctcgcagaagccaacagaaccatcaccgcgagggtgggcttgagctatatcagcgcccagaaggcgtgccggaacgcagaggcggagattccaagcccgctgtcggatttcaatcgtcttagagcagctgccgaggatgcttggagggacaaactgagcccgataaccctagacgccggtgaggtcagccaggacttgcagaagaacttctggagctcgatttacaggacaatgatctcaccccaggactatacgggcgagaatccacgctggaacacgtcagtttatttcgactcgttctattgcctgtgggaccagttcaggtctcagctgcccctgctcaccattctggatccgacggcttattcagacatgctgaacagtctcctgttcatctaccagaatgagggttggctgccggattgccggatgagtttaagcaagggctggactcagggaggctcgaatgcagatgtggtactggtggatgcttatttcaagaacgtcaccggtgtggactgggaccttgcctggaaggccgttgtgaatgatgcagaaaatgagccgctggaatggtcaaaggaaggtagaggaggcctgctgtcctggaagaacctccactatattccggcccttgattttgactatcttggtttcgggactaactcgagaagcatctcacgcaccttggaatacgcttacaacgattattgcatcggagcgcttggaagagcactggccaaggatggatatgagacgtatttggcccggggcaacaactggaagaacctcttcaaagaggatcaaacttcgattatcaacggcacagattcaggcttcgtcggcttcttccaacccaagtacctgaacgcaacttggggtttccaggatccgatctcgtgcagccctgtggcggggttctgttccctgacaagcaacccttcggagacgtttgaatcaagtatctgggagtatcagtttttcgtaccccaagacatggaaacgctcattgcaagacttggtggagatcaaagatttgtcgaccggctggactatttccacgagtcgcccctcgtagatataggaaatgagccggtgttcttgagcgtcttcgaataccattacgcagggaggcctgccctttcagcacgacgctctcattcttacatcccgtctcgcttcaacacttcctacagtggcctaccaggaaatgatgatagtggcgcaatgggttcttatgcagctttcaacatgatgggcctctttcccaaccctggccagaacgtctactttattattccgccgtatttcccgagaatgcaagtgcggcatccagtaacgaatcggacggcgacgatacgtgcggataatttcgacgccgcttacagcaacatctacatccagaatgcgacgctgaatggagagccgtacaccaaaaactggattgggcatgagttcttcacgcagggcggcgagctggtcctgaccctaggtagcgaggagagccagtggggaacagctgtagaggatcgaccgccttcggagactggaggaagtcggactgaggagcggtcttggagcggcctttag

SEQ ID NO: 207 - protein, 793 aa, M. phaseolina
MNAMFGFLIALACAASPIAAQAGGDFDILDFVDPLIGSNGGGNVFCGATLPYGLAKASADVDGQNTAGFSTDGSNVIGFSSLHDSGTGGNPSLGNFPLMPQLCAENDINNCSFSKQARATPYRNDSIVARPGYFALTLDNGISAEMTVSQHAALHNFKFPDVNASDGTQLVPMVLLDLTDLWDSRQNGTFQAQGTRMTGNGTFLPSFGAGSYEVHFCVDFFGHTGPVYDSGIWVNERGGSDQKEIFVTRGFNNFYLQAGGFVRLLAEANRTITARVGLSYISAQKACRNAEAEIPSPLSDFNRLRAAAEDAWRDKLSPITLDAGEVSQDLQKNFWSSIYRTMISPQDYTGENPRWNTSVYFDSFYCLWDQFRSQLPLLTILDPTAYSDMLNSLLFIYQNEGWLPDCRMSLSKGWTQGGSNADVVLVDAYFKNVTGVDWDLAWKAVVNDAENEPLEWSKEGRGGLLSWKNLHYIPALDFDYLGFGTNSRSISRTLEYAYNDYCIGALGRALAKDGYETYLARGNNWKNLFKEDQTSIINGTDSGFVGFFQPKYLNATWGFQDPISCSPVAGFCSLTSNPSETFESSIWEYQFFVPQDMETLIARLGGDQRFVDRLDYFHESPLVDIGNEPVFLSVFEYHYAGRPALSARRSHSYIPSRFNTSYSGLPGNDDSGAMGSYAAFNMMGLFPNPGQNVYFIIPPYFPRMQVRHPVTNRTATIRADNFDAAYSNIYIQNATLNGEPYTKNWIGHEFFTQGGELVLTLGSEESQWGTAVEDRPPSETGGSRTEERSWSGL

SEQ ID NO: 208 - DNA, 3232 bp, M. phaseolina
cctttccagtcccgccccggcccttgcgccgcggctgacatcaacagccgagtgttcctgacgatccggaccgctcaaaatacccatcatgtcccgcttcgcgtacttccaaccccccctctgcactccaactgtccgccgtgggtcagcatggcggggtcgttcgcactcttcgcactggccctggccgcttgcgcacaacatgctcaagcccaaaccgcttccgcctacgacttctttgactacatagatcccctgatcggaacagtcaatggaggtgtgtatcatctcaagggactcaaagtcgccgctgattacgctattagggcacgtattccccggcgccactttgccctttgggatggcaaaggctgtggcagacgttaccggcgagaaccaaggtggctacgccagcgacgacagcgagatagtcggattttcccacatggtatagctctcgagccgcccgactctatacctcctgctcactctgttctttccagcatgactcaggcacaggtggttcgccttctctgggaaactttccacttttccgtgagtcaaacacccttcagtcgctgttgtacggtgctgatcacaagagcagctcaggcaggttgcccaggagatgatttgaacagatgcgaatttcctgccgctgaccgcgctgtcaagcgtatatctcccccatgctgcctctttctattccctcttctgaacagtccacaggtattaatggcaccgcattcgcttccccgggctactttacagtgacgctcaatacaagcatcaaggccgagaccaccgtgactaaccacactgcactctggcgattcaccttcccggatgtccctgtttcgccaaatggcggaaactccactgcaccgctgagcccgcttatcttggtagacctcagagacctccccagctcaaggtcctacggccaaatcgccgtggaccctgacactggcagaattaccggaaatggcacattcgagccgtctttcggaatcggcacttataatctatctttctgcgccgatttctccggcgccaatgtacgcgacacaggcgttttcaagaataaccgagccggctcagaaccgaagaatctgcaggtagtgccggataacgtcaatacgggaagcgacatcctcccagcgggtgcgtgggttcggttcgaagctcctgccagtaacaatcagatcaccgcacgcgtcggcatgagtttcattggcgttgaaaaggcctgccagaatgctgagagcgagattcccggctatgactttgaagctgtgcacaccgctgccgaggatgcctggaggcacaaactcagtgtcgtttccattgaccccgccggtgtcaacgaaagcctgcaaacgacgttttggtccgggtgagtcaaaggacggatgtgtcaaaaaatgcggtctccttactaacctatgcacaggctgtaccgtaccatgatctccccgcaggactacacgggggagaattacctatgggaatctgatgagccctactacgactccttctactgcatctgggattcgtatcggagtattcaccccttgcttaccctcctggatcccgaatctcaaacaagaatggttcggagtttgattgacatctatcgcaatgagtaagtaattccatggcagcgcaatgtagccggtgttctaacgcaccatcaaaggggatggctaccggattgccgcatgagtctctgcaagggcttcacgcagggaggctcaaacgcagatgtagtactcgtggactctttcctcaagaacatcactcaggatgtggactgggatacaggctacgaagcgctgctcaaaggtttgttatatcgctttcccattgccccagctcggatggctgacaggctgcagacgccgaagaggagccgctaaattgggctggtaggatctcagaatcttctgtgcagtctgtgtgctaattgcccatagttgagggccgaggcggcctaaacagctggaagaatctgggttatatcccaactgtaagaccacttccaagaagcgcctgtatggtgtgctgactgttcaggatgactatgacccgtacggagtgggtcctttcactcgatctatctcaagaaccgtggaatacgcatacaacgattatgtgatagcgctcatggcacaaaagctcgggaaaactggtgactacgaaaagtacctggagcgcagcaataactggaggaacatgttcaaggaagatgaggtgagagggttcttataacttcaagacatcttatgctaaactcccacaggtttccttctttaacacaacgccaggcggtcccaaggaagacagcggcttcacaggcttcctccaagtcaagtacctcaacggcacctggggctaccaagacccgatcctctgctccagcctctacaacttcaccagctgttacctcaatccagatggccacgagacctacgaaggctccagctggctctataccttctacgtcccgcaggacatggctaccctggtcaccgcgctcggcggccccgaaactttcacccgccgggtgcagtacctgcactacacctacaatctcctctacatcggcgatgagcaggccttcctgaccgtctacctcgcccactactccggccgccccgccgtctctgccgagatcgcgcacttctatatccccgcgcaattcaacgacaccgtcatcggcatccccggcaacgacgacagcggcgccatgggcagcttctccagtttgaccatgatggggatatggccggtcgcgggacaggacgtctatctgatcatcccgcccttcttccgcgaggtcaaaatcacgaatccggtgacgaggaagacggcgacgatcaggaacatcaattttgattcgtcttaccaggcgatctacgtgcagagcgcaacgttggatggagaggcgtatacgaagagctgggttacgcatagcttcttcttggaaggtggtgtgctggagctcacgctggggaggaatgagagtgattgggggagggcagatgccgatcggccaccgagtgcgtcgacctctggttaaattcgggacgcaaaggccaaggcacctagtctggcgctgctagattacattaattataatgcctgcaatgattgactggctgccagaacgagtttcctctgcaccttttgatcactgctttgcactcttaaatttccatcacaatatgca

SEQ ID NO: 209 - DNA, 2415 bp, M. phaseolina
atggcggggtcgttcgcactcttcgcactggccctggccgcttgcgcacaacatgctcaagcccaaaccgcttccgcctacgacttctttgactacatagatcccctgatcggaacagtcaatggagggcacgtattccccggcgccactttgccctttgggatggcaaaggctgtggcagacgttaccggcgagaaccaaggtggctacgccagcgacgacagcgagatagtcggattttcccacatgcatgactcaggcacaggtggttcgccttctctgggaaactttccacttttccctcaggcaggttgcccaggagatgatttgaacagatgcgaatttcctgccgctgaccgcgctgtcaagcgtattaatggcaccgcattcgcttccccgggctactttacagtgacgctcaatacaagcatcaaggccgagaccaccgtgactaaccacactgcactctggcgattcaccttcccggatgtccctgtttcgccaaatggcggaaactccactgcaccgctgagcccgcttatcttggtagacctcagagacctccccagctcaaggtcctacggccaaatcgccgtggaccctgacactggcagaattaccggaaatggcacattcgagccgtctttcggaatcggcacttataatctatctttctgcgccgatttctccggcgccaatgtacgcgacacaggcgttttcaagaataaccgagccggctcagaaccgaagaatctgcaggtagtgccggataacgtcaatacgggaagcgacatcctcccagcgggtgcgtgggttcggttcgaagctcctgccagtaacaatcagatcaccgcacgcgtcggcatgagtttcattggcgttgaaaaggcctgccagaatgctgagagcgagattcccggctatgactttgaagctgtgcacaccgctgccgaggatgcctggaggcacaaactcagtgtcgtttccattgaccccgccggtgtcaacgaaagcctgcaaacgacgttttggtccgggctgtaccgtaccatgatctccccgcaggactacacgggggagaattacctatgggaatctgatgagccctactacgactccttctactgcatctgggattcgtatcggagtattcaccccttgcttaccctcctggatcccgaatctcaaacaagaatggttcggagtttgattgacatctatcgcaatgagggatggctaccggattgccgcatgagtctctgcaagggcttcacgcagggaggctcaaacgcagatgtagtactcgtggactctttcctcaagaacatcactcaggatgtggactgggatacaggctacgaagcgctgctcaaagacgccgaagaggagccgctaaattgggctgttgagggccgaggcggcctaaacagctggaagaatctgggttatatcccaactgatgactatgacccgtacggagtgggtcctttcactcgatctatctcaagaaccgtggaatacgcatacaacgattatgtgatagcgctcatggcacaaaagctcgggaaaactggtgactacgaaaagtacctggagcgcagcaataactggaggaacatgttcaaggaagatgaggtttccttctttaacacaacgccaggcggtcccaaggaagacagcggcttcacaggcttcctccaagtcaagtacctcaacggcacctggggctaccaagacccgatcctctgctccagcctctacaacttcaccagctgttacctcaatccagatggccacgagacctacgaaggctccagctggctctataccttctacgtcccgcaggacatggctaccctggtcaccgcgctcggcggccccgaaactttcacccgccgggtgcagtacctgcactacacctacaatctcctctacatcggcgatgagcaggccttcctgaccgtctacctcgcccactactccggccgccccgccgtctctgccgagatcgcgcacttctatatccccgcgcaattcaacgacaccgtcatcggcatccccggcaacgacgacagcggcgccatgggcagcttctccagtttgaccatgatggggatatggccggtcgcgggacaggacgtctatctgatcatcccgcccttcttccgcgaggtcaaaatcacgaatccggtgacgaggaagacggcgacgatcaggaacatcaattttgattcgtcttaccaggcgatctacgtgcagagcgcaacgttggatggagaggcgtatacgaagagctgggttacgcatagcttcttcttggaaggtggtgtgctggagctcacgctggggaggaatgagagtgattgggggagggcagatgccgatcggccaccgagtgcgtcgacctctggttaa

SEQ ID NO: 210 - protein, 804 aa, M. phaseolina
MAGSFALFALALAACAQHAQAQTASAYDFFDYIDPLIGTVNGGHVFPGATLPFGMAKAVADVTGENQGGYASDDSEIVGFSHMHDSGTGGSPSLGNFPLFPQAGCPGDDLNRCEFPAADRAVKRINGTAFASPGYFTVTLNTSIKAETTVTNHTALWRFTFPDVPVSPNGGNSTAPLSPLILVDLRDLPSSRSYGQIAVDPDTGRITGNGTFEPSFGIGTYNLSFCADFSGANVRDTGVFKNNRAGSEPKNLQVVPDNVNTGSDILPAGAWVRFEAPASNNQITARVGMSFIGVEKACQNAESEIPGYDFEAVHTAAEDAWRHKLSVVSIDPAGVNESLQTTFWSGLYRTMISPQDYTGENYLWESDEPYYDSFYCIWDSYRSIHPLLTLLDPESQTRMVRSLIDIYRNEGWLPDCRMSLCKGFTQGGSNADVVLVDSFLKNITQDVDWDTGYEALLKDAEEEPLNWAVEGRGGLNSWKNLGYIPTDDYDPYGVGPFTRSISRTVEYAYNDYVIALMAQKLGKTGDYEKYLERSNNWRNMFKEDEVSFFNTTPGGPKEDSGFTGFLQVKYLNGTWGYQDPILCSSLYNFTSCYLNPDGHETYEGSSWLYTFYVPQDMATLVTALGGPETFTRRVQYLHYTYNLLYIGDEQAFLTVYLAHYSGRPAVSAEIAHFYIPAQFNDTVIGIPGNDDSGAMGSFSSLTMMGIWPVAGQDVYLIIPPFFREVKITNPVTRKTATIRNINFDSSYQAIYVQSATLDGEAYTKSWVTHSFFLEGGVLELTLGRNESDWGRADADRPPSASTSG

SEQ ID NO: 211 - DNA, 4669 bp, M. phaseolina
gacactacgagagtgattgtgcactgagatcgaatgcgcaactatgaaggaagttacgtctttgtacatatgcaaccgcctcatatgcggtccggagtacaaaaaccgtcattcgtaacgtgcgacggtcgatgcagtgcaacgtcagccatgttccggaaggctcaaagctacacgtggagtccaccagattcgggtgaaacatctgtgaagatcaagtgcacagtgcagtgcgtcgacgtgcacctgcacagaggcacgcaagtagcgaagctggcccccccgccccgacaatcgaccgcctgagggcgacccgacggaagtcggccttgccactgtcgccgaggcctggggctgaggtgaacactgccattattgccaatcgcacggcgcactcttccaagccgactgtcgttcaggaagtggtggcaagccaagttccgaggcgctgaggcggtgcggcaggatggtcacggcacagggccgagcaaggcagtgatgatatttcaggacgaggcgttggtcggccaagtcatttcagtcctggcctgggtggactaaacccacccaccttccgagtcctcatcccatcacctctccttgagagaggagtgcggagattcgcgagccaaccacagcagctaaacacgacgacaggattgcaattcgagagctccgtgattctacaacgtcggtcgaaacggggatcgagcgtgcaggagcgcaaaagtcttgtgacagcaaagtgtagatggttcggcggggggtgaagttggtagagcgagcaaagagggttcgggaggggctcttcagcggcagcagcgtggggaatccgctgccgccagccgaagcgaagttccaggaacaccaatgagaagccggcgtctcggggcgtgcaccatgcaatgcacgtagctcctcggggaagtctgcccctcacatcaccattccgcctccgaactcctgcaggctcgcccgtccagaagatcaaacatgcgccgccaaagtgcgtacctgtttccagcctcgaacgcccacgggtagctcgtataacttactttcgacctcatttctcccatcacaggcaaggcaggacgcgcgcggcagcatgctatcttcactagcgcaatacagcctcttcctgcatctaaacctgcagccaaccctgcggcgctaccaacgacccgcgtgctaccatgtcctctatgcccagtggggctgtgatgagcacgcctgctctcaaaggctcctgatacgctcacgcgctaaccacctgcccctcgtgctgatcccgctgcagccaccctatcgccgcacctcctcgaccagcgtgttcagtctccgtccgttttgtgagaaactgacacctgctcgtgtgcggccccgcggatgcttgcaagacattctgggtggggttcaccgcctgcgctggtctttaaaaaagagagaccaagccttggagaagccgtctcaagactcccaagaaacccgctgcgcatttcttgggctcgtgccgccactcttgcgagctggtcaatcttccaacctgcagcgcgtctctattcttgtcatggcagggtgcggtgcctaaagcggaccctgactttataagacgcgcgactcttcgatcccaggtgcctgttaccaccactctcgtgtctggcttttacatcctcgtccctcgctcaacagacaaaaccccttattctttatttcaattccaacctcccgctcttttgacttcgacttgcaccaaggccccactgatgggcatggcatacatcgtttcgttcctgacgctggctggcgcagcgctggcccagtccgtagactacactcaattcgttgatccattgtgagattcccgcatacctccaagctcttctcactgccaagcatgacgagcaaaaacaaaaaaaaaaatatttccctcacctgctccctccgccaactttcaactaacaggccccctccagccacggcaccgaaaatggcggtaataccttccccggcgtcgtgcccggtaagaccaacaacaacaccaacatcaccatcaccaccaccaccaacaacaacaacaacaaaatcctccaacccaaaactccaccccccctcttaacgcacaccagaaactaacacacccacgttagcacccttctccgtcactaaactcggcatcgacgtctcctccggcaccacggacgcctactcgggctacctgccgaccggcaacgtgacgggctacagcatgctgcacgagagcggcacgggcggcgcgcccaagtacggcgtcgtcgcgcagctgcccgtcgtcggcgccgtcgccaacccgctcgccgacctgagcgtgccgcgcgcggtcgacgacgtcgcggccgtcgggtactaccgctcggtgctggcgagcggggtgagcgtggagctggcggggacggcgcacgcgggactgtacgtttacgggttcccggcggcgcgggggagcgtggtggtggacgtgtcgcacgtcttgccgtcgtttcgcggactggggtgggggcagggctatgcgggaggggagttcgaggtgtttgaggatgggcggtacgagggtcacgggacgtataataatgggtggaatctcggtgagtggggtggtgttttttcccccctttttttggctgccgtctcttggatggaaactaacgagggcgcagcgccgaactggaccatctacttttgcggccgcttcaacgtcacggctgcgagtagtaagaccttcgccgggaatggaacggtgctctcgcaatatggagagcaggcgtccgtttctggggcggagcgtctaggcggcgtgttcacgtttaatgagacagcagtttcatcgagggtcggcgtgtcgttcatctcttcggagaaggcgtgcgggttcttggaggacgagctgccgtccgatgcaacgctggattcgctggtccatgattcgcgggaaacttggaattcagaggttttctcgaaggtcacgacgaccgaaacgaacacgacttatttgacgcagctgtactccagcttgtacgggatgcatctcatcccgtcgaaccgcacgggagagaaccctctgtgggaatccgatgagccatactacgatgactgtaaattgaaccatcagcatcttggcctaacactgctaacaaggggctagggtttacgctttgggatcttttccggtgcaccacgcccttgatgcatattctccagcccgaggcatacgaagagcaaatcaggtctttcatcgacatctggaggcatgacggattcatgcctgacgcgaggtcttcgaattggaatggccgcgtccagggaggaactaacgccgataatgttcttgcggatgcatatgtgaaaggtgtcagaggagccattgactgggaggacggatacagtgagttactccagccctccttcgacttggcatcgtccagagaaaaaggaaatggaggaaaaggcatatgctgacagctcctcagccgccatggtcacagatgcggagacggtgccagccaacagctatgatccctcgacagcgcccgacgtgtcatccactaaagaggggcggggagcgctgccggactggctgaagtatgggtggatcacgcccacatactcacgagcggtctcgcgggcggtggagtactcggcgaatgacttcggcctcttccaggtggctgacgggctagggcggagcgacgacgccaccaaatatctccgcaggtcccgcaactggcgcaaccactggaaccccaacgcaacagtctcggggatcagtggattcgtggtgccgcgcaatgccgacggcagcttcgtgcggcaggaccctcttgcatgtggatcgtgctattgggatgctccctactacgaagacaacccgtacacgtacagcttcaacgcgatacacgacctagcggacgtgataaccaagtcgggcgggccagccaggtttgtcgagcgattggacgcgttcttctcgcaagggctgtacaacccgggcaacgagccgagcttcacaacaccttacctatacaactacgcgggccgccaggagctcacggtccggcagatccgcacgacgggctacagcaactacaatgcggggcggggcgggatcccgggcaacagcgacgcgggggcgatgcagagctggattctctggaacatggtcgggctctatccggtgacggggcagacgacgttcctcgtggggagcccgtggttcgagcaggtgacgatcgggctgggcggcggcaagttcctcaacatcacgtccaatctgggggcgcaggagcagcgcgagcagggcgcgttctacgtgcagagcttgagggtgaacggcgaggcgtgggatagggcgtgggtcacatgggaggaggtgttcgcgaatggcggggagatgtcgttcgtgcttggcgcgtcgccgcaggcctgggcgacgggggatgcgcctccaagcccggcgtccggggcgggagacagcgcgccagcctgatgccagctcaggccggggggcgtgagcaacagggacgcgggcggtgaaacagcggggtgcggtacagggtacggtggcttgtctagcctccaggcggcgacgcgggcgctgtgggcggctgggtcggtgtcggcggtgctgcttgtagcg

SEQ ID NO: 212 - DNA, 2289 bp, M. phaseolina
atgttccggaaggctcaaagctacacgtggagtccaccagattcgggtgaaacatctgtgaagatcaagtgcacagtgcaccacggcaccgaaaatggcggtaataccttccccggcgtcgtgcccgcacccttctccgtcactaaactcggcatcgacgtctcctccggcaccacggacgcctactcgggctacctgccgaccggcaacgtgacgggctacagcatgctgcacgagagcggcacgggcggcgcgcccaagtacggcgtcgtcgcgcagctgcccgtcgtcggcgccgtcgccaacccgctcgccgacctgagcgtgccgcgcgcggtcgacgacgtcgcggccgtcgggtactaccgctcggtgctggcgagcggggtgagcgtggagctggcggggacggcgcacgcgggactgtacgtttacgggttcccggcggcgcgggggagcgtggtggtggacgtgtcgcacgtcttgccgtcgtttcgcggactggggtgggggcagggctatgcgggaggggagttcgaggtgtttgaggatgggcggtacgagggtcacgggacgtataataatgggtggaatctcgcgccgaactggaccatctacttttgcggccgcttcaacgtcacggctgcgagtagtaagaccttcgccgggaatggaacggtgctctcgcaatatggagagcaggcgtccgtttctggggcggagcgtctaggcggcgtgttcacgtttaatgagacagcagtttcatcgagggtcggcgtgtcgttcatctcttcggagaaggcgtgcgggttcttggaggacgagctgccgtccgatgcaacgctggattcgctggtccatgattcgcgggaaacttggaattcagaggttttctcgaaggtcacgacgaccgaaacgaacacgacttatttgacgcagctgtactccagcttgtacgggatgcatctcatcccgtcgaaccgcacgggagagaaccctctgtgggaatccgatgagccatactacgatgactggtttacgctttgggatcttttccggtgcaccacgcccttgatgcatattctccagcccgaggcatacgaagagcaaatcaggtctttcatcgacatctggaggcatgacggattcatgcctgacgcgaggtcttcgaattggaatggccgcgtccagggaggaactaacgccgataatgttcttgcggatgcatatgtgaaaggtgtcagaggagccattgactgggaggacggatacaccgccatggtcacagatgcggagacggtgccagccaacagctatgatccctcgacagcgcccgacgtgtcatccactaaagaggggcggggagcgctgccggactggctgaagtatgggtggatcacgcccacatactcacgagcggtctcgcgggcggtggagtactcggcgaatgacttcggcctcttccaggtggctgacgggctagggcggagcgacgacgccaccaaatatctccgcaggtcccgcaactggcgcaaccactggaaccccaacgcaacagtctcggggatcagtggattcgtggtgccgcgcaatgccgacggcagcttcgtgcggcaggaccctcttgcatgtggatcgtgctattgggatgctccctactacgaagacaacccgtacacgtacagcttcaacgcgatacacgacctagcggacgtgataaccaagtcgggcgggccagccaggtttgtcgagcgattggacgcgttcttctcgcaagggctgtacaacccgggcaacgagccgagcttcacaacaccttacctatacaactacgcgggccgccaggagctcacggtccggcagatccgcacgacgggctacagcaactacaatgcggggcggggcgggatcccgggcaacagcgacgcgggggcgatgcagagctggattctctggaacatggtcgggctctatccggtgacggggcagacgacgttcctcgtggggagcccgtggttcgagcaggtgacgatcgggctgggcggcggcaagttcctcaacatcacgtccaatctgggggcgcaggagcagcgcgagcagggcgcgttctacgtgcagagcttgagggtgaacggcgaggcgtgggatagggcgtgggtcacatgggaggaggtgttcgcgaatggcggggagatgtcgttcgtgcttggcgcgtcgccgcaggcctgggcgacgggggatgcgcctccaagcccggcgtccggggcgggagacagcgcgccagcctga

SEQ ID NO: 213 - protein, 762 aa, M. phaseolina
MFRKAQSYTWSPPDSGETSVKIKCTVHHGTENGGNTFPGVVPAPFSVTKLGIDVSSGTTDAYSGYLPTGNVTGYSMLHESGTGGAPKYGVVAQLPVVGAVANPLADLSVPRAVDDVAAVGYYRSVLASGVSVELAGTAHAGLYVYGFPAARGSVVVDVSHVLPSFRGLGWGQGYAGGEFEVFEDGRYEGHGTYNNGWNLAPNWTIYFCGRFNVTAASSKTFAGNGTVLSQYGEQASVSGAERLGGVFTFNETAVSSRVGVSFISSEKACGFLEDELPSDATLDSLVHDSRETWNSEVFSKVTTTETNTTYLTQLYSSLYGMHLIPSNRTGENPLWESDEPYYDDWFTLWDLFRCTTPLMHILQPEAYEEQIRSFIDIWRHDGFMPDARSSNWNGRVQGGTNADNVLADAYVKGVRGAIDWEDGYTAMVTDAETVPANSYDPSTAPDVSSTKEGRGALPDWLKYGWITPTYSRAVSRAVEYSANDFGLFQVADGLGRSDDATKYLRRSRNWRNHWNPNATVSGISGFVVPRNADGSFVRQDPLACGSCYWDAPYYEDNPYTYSFNAIHDLADVITKSGGPARFVERLDAFFSQGLYNPGNEPSFTTPYLYNYAGRQELTVRQIRTTGYSNYNAGRGGIPGNSDAGAMQSWILWNMVGLYPVTGQTTFLVGSPWFEQVTIGLGGGKFLNITSNLGAQEQREQGAFYVQSLRVNGEAWDRAWVTWEEVFANGGEMSFVLGASPQAWATGDAPPSPASGAGDSAPA

SEQ ID NO: 214 - DNA, 2912 bp, M. phaseolina
cctgtcgatgcgggtgacggatgatcacgccttgttccctggactcatgtatatctcgccccgcgccccgtgtcggctgcttgctgctgtaggttcgtcgccctctgtcgcgtcgtctctgaattcgctcgtttcgtcttctctttgaccatgggcctcaagcatctacccgctctcttgctggctggcctctgtacctctccggtgcacgctcagttcgatgctctgcagtatgtcgatcagctgattggcagcagcaacggcggtgcgtttcgaagtatctgggcagggatcatgcgctgaaacaacgaccaggaaatgtcttctctggcgcaggccttccttacggaatggtatgtccatactcactgcaaacctgacaggaacacatactgtcgtacaaaacgactgagtgctaagctgcctcgcaggccaaagccgtggcggacacggattcccagagtaaccagggtggcttcacgactgatggtgccaacatcaccggcttcagccagatgcacgattccggaacaggagggagcccttctcttggactcttcgccctgttcccttaccccagctgccgtggcgacgatgtcaacaactgcgtcttccccaagagagctcggcggactcggtaccggaacgagtcgctgcaagccagtcccggctacttcagcctgactctgaacagcggtgtgaatgtcgagatgacttccgctcagcacaccaatcttttcaggttcaatttcccttctgatacggacgggagccccctgatccttttggatctgaccgacctctcagattcccgccaggataacggaaccatcaccgttgatggcgacaccggaaggatgtctggaaatgctcggttcaatcccagtttcggacagggcaactacgtagcgtatttctgcgcggatttccaaggtcccaacattcgcgataatggaatctttgtcaatagccgggccagtgctgacgtcaagaacctcaccatttcgcgctccatcaacggatatcctcttcccggcggcggtttcacccgatttgatggccccggcgagaacggtgtccttgcccgcgtgggcgtcagcctcatcagcgagcagcaagcttgcagtaacgccgagtccgagattccggatttcaacttcgagcgcgtgcagactgaggcagtccaacagtggagacagaagctcagccccatccaggcatcaacaaacggcgtcgatcgggacttgctcgtcaacttttacagtggtatctaccgcgccttcgtcaaccctcaggattacactggagagaacccgttgtggcagagtgacgagccgtactttgactcgttctactgcatctgggatcttttccgctctcagatgccgtttttgacaatcgtggatcccgaagcagtctccaggatggttcgatctctcattgacacatacaggaatgttggttggcttccagactgccgcatgaccctgaacaagggctacacgcaaggcggatccaacgccgacgtaattcttgccgatgtgtacttgaagggcgtgagagatggaattaattgggaggacggctacgccgctgtcgtgaaggatgcagaagtcgaaccctacgactggtgctgccaaggccgcggggggctcgatagctggaagtcactgggctatattccggtggaggacttcgactacaaggggtttggtaccatgacccggagtgtctctcgcactcttgaatactcgtacaacgacttcactatctcggaactcgccggtaggattggcaacctggaagccgatgtggagaagtaccaggaacgcagcggcaactggcagaacctctttaaggttaatcagacttccttcctgaacggcactgatactggcttcgtcggattcttccaaccgcgctacctcaacggcacctggggcttccaggacccgctgcggtgcagcaacatcgacccctttcccaacagcgtctgcagcctgcagaacactgctggcgagacgttcgaatcctccatctgggaatacagctactacgtccctcacgaccaagctgcactcatcactgcctttggcgggcccgctgagttcgtgcgccggctcgagtatctgcatgaccgcaacatcacgtacatcggtaacgagccctctttcctcaccgtcttccagtaccattacgcaggacggcctgcactttcggcccgccgcagccactactacatcccgggcttcttcggcaccacgttcgacggcctgcccggcaacgacgatagcgggaccatgggggccttcgtcgccttctccatgatgggtctcttccccaacccgggccaggacgtgtacttcatcatccccccttacttcgagtcggtcaacatcacccacccgctgaccaaccgcaccgccaccatccgcaacgtcaacttcgatcccagttacgaggcgatttatatccagagcgcgacgctcgacggcgagccgtacacgaagaattggatcgaccactcctttttcacagagggcaaggagcttgtgctcacgctcggcaggaacgagagcgcgtggggcacccgcgtcgaggatctgccgcccagtttgagcgaatatcaaggcttcaactcgagcgcggcgaccgcagcggggagcaggagggcggccttgaagaggagtgccccgaagatcgcgccaagacaccccatggcgatggatttctggcccgagggaaaggttgtggagttttagcgagtgaaggaggtttatgtggctgggacttgcgttttcgcttcttatgacgggctgccgactgcgtgcggcaggcgctttgatggcagtgagcgggtgtcttgctgaccggattatagataatgcaaaggaaaatatatttctcctgac

SEQ ID NO: 215 - DNA, 2484 bp, M. phaseolina
atgggcctcaagcatctacccgctctcttgctggctggcctctgtacctctccggtgcacgctcagttcgatgctctgcagtatgtcgatcagctgattggcagcagcaacggcggaaatgtcttctctggcgcaggccttccttacggaatggccaaagccgtggcggacacggattcccagagtaaccagggtggcttcacgactgatggtgccaacatcaccggcttcagccagatgcacgattccggaacaggagggagcccttctcttggactcttcgccctgttcccttaccccagctgccgtggcgacgatgtcaacaactgcgtcttccccaagagagctcggcggactcggtaccggaacgagtcgctgcaagccagtcccggctacttcagcctgactctgaacagcggtgtgaatgtcgagatgacttccgctcagcacaccaatcttttcaggttcaatttcccttctgatacggacgggagccccctgatccttttggatctgaccgacctctcagattcccgccaggataacggaaccatcaccgttgatggcgacaccggaaggatgtctggaaatgctcggttcaatcccagtttcggacagggcaactacgtagcgtatttctgcgcggatttccaaggtcccaacattcgcgataatggaatctttgtcaatagccgggccagtgctgacgtcaagaacctcaccatttcgcgctccatcaacggatatcctcttcccggcggcggtttcacccgatttgatggccccggcgagaacggtgtccttgcccgcgtgggcgtcagcctcatcagcgagcagcaagcttgcagtaacgccgagtccgagattccggatttcaacttcgagcgcgtgcagactgaggcagtccaacagtggagacagaagctcagccccatccaggcatcaacaaacggcgtcgatcgggacttgctcgtcaacttttacagtggtatctaccgcgccttcgtcaaccctcaggattacactggagagaacccgttgtggcagagtgacgagccgtactttgactcgttctactgcatctgggatcttttccgctctcagatgccgtttttgacaatcgtggatcccgaagcagtctccaggatggttcgatctctcattgacacatacaggaatgttggttggcttccagactgccgcatgaccctgaacaagggctacacgcaaggcggatccaacgccgacgtaattcttgccgatgtgtacttgaagggcgtgagagatggaattaattgggaggacggctacgccgctgtcgtgaaggatgcagaagtcgaaccctacgactggtgctgccaaggccgcggggggctcgatagctggaagtcactgggctatattccggtggaggacttcgactacaaggggtttggtaccatgacccggagtgtctctcgcactcttgaatactcgtacaacgacttcactatctcggaactcgccggtaggattggcaacctggaagccgatgtggagaagtaccaggaacgcagcggcaactggcagaacctctttaaggttaatcagacttccttcctgaacggcactgatactggcttcgtcggattcttccaaccgcgctacctcaacggcacctggggcttccaggacccgctgcggtgcagcaacatcgacccctttcccaacagcgtctgcagcctgcagaacactgctggcgagacgttcgaatcctccatctgggaatacagctactacgtccctcacgaccaagctgcactcatcactgcctttggcgggcccgctgagttcgtgcgccggctcgagtatctgcatgaccgcaacatcacgtacatcggtaacgagccctctttcctcaccgtcttccagtaccattacgcaggacggcctgcactttcggcccgccgcagccactactacatcccgggcttcttcggcaccacgttcgacggcctgcccggcaacgacgatagcgggaccatgggggccttcgtcgccttctccatgatgggtctcttccccaacccgggccaggacgtgtacttcatcatccccccttacttcgagtcggtcaacatcacccacccgctgaccaaccgcaccgccaccatccgcaacgtcaacttcgatcccagttacgaggcgatttatatccagagcgcgacgctcgacggcgagccgtacacgaagaattggatcgaccactcctttttcacagagggcaaggagcttgtgctcacgctcggcaggaacgagagcgcgtggggcacccgcgtcgaggatctgccgcccagtttgagcgaatatcaaggcttcaactcgagcgcggcgaccgcagcggggagcaggagggcggccttgaagaggagtgccccgaagatcgcgccaagacaccccatggcgatggatttctggcccgagggaaaggttgtggagttttag

SEQ ID NO: 216 - protein, 827 aa, M. phaseolina
MGLKHLPALLLAGLCTSPVHAQFDALQYVDQLIGSSNGGNVFSGAGLPYGMAKAVADTDSQSNQGGFTTDGANITGFSQMHDSGTGGSPSLGLFALFPYPSCRGDDVNNCVFPKRARRTRYRNESLQASPGYFSLTLNSGVNVEMTSAQHTNLFRFNFPSDTDGSPLILLDLTDLSDSRQDNGTITVDGDTGRMSGNARFNPSFGQGNYVAYFCADFQGPNIRDNGIFVNSRASADVKNLTISRSINGYPLPGGGFTRFDGPGENGVLARVGVSLISEQQACSNAESEIPDFNFERVQTEAVQQWRQKLSPIQASTNGVDRDLLVNFYSGIYRAFVNPQDYTGENPLWQSDEPYFDSFYCIWDLFRSQMPFLTIVDPEAVSRMVRSLIDTYRNVGWLPDCRMTLNKGYTQGGSNADVILADVYLKGVRDGINWEDGYAAVVKDAEVEPYDWCCQGRGGLDSWKSLGYIPVEDFDYKGFGTMTRSVSRTLEYSYNDFTISELAGRIGNLEADVEKYQERSGNWQNLFKVNQTSFLNGTDTGFVGFFQPRYLNGTWGFQDPLRCSNIDPFPNSVCSLQNTAGETFESSIWEYSYYVPHDQAALITAFGGPAEFVRRLEYLHDRNITYIGNEPSFLTVFQYHYAGRPALSARRSHYYIPGFFGTTFDGLPGNDDSGTMGAFVAFSMMGLFPNPGQDVYFIIPPYFESVNITHPLTNRTATIRNVNFDPSYEAIYIQSATLDGEPYTKNWIDHSFFTEGKELVLTLGRNESAWGTRVEDLPPSLSEYQGFNSSAATAAGSRRAALKRSAPKIAPRHPMAMDFWPEGKVVEF

SEQ ID NO: 217 - DNA, 2066 bp, M. phaseolina
gcggcgacaggagctgttcttgattcatcagggcgcagcctgtgcctgccaagttcccgggctgcgggatcttaaaagctgccggcccgccgctctggatagtcggtagtccacggcatcactatcaccgtgctgcaacctccaaacacaatgcgctgggcctcgactctgctgccgtccgccaccggcgcgctgctcttcgctgccctggcaaatggcgctcccgcagtcggctccgccgccacgcccacgctgaaggagaggcagacgtccgacagattagtcttcgcccatttcatggtatgtacatgcacacgcatctcgccaagccacaagcttgtgctaaccagccgccagatcggcatctcgaccgaccgcaccagctccgccgattacgacgccgacatcctgcgtgccaaatctctaggcattgacgccttcgctctcaacttcggccccgacaccgccagcgccaactacagccagcaactcgtgtacgcctatgagtcggccgccaacaacggcttcagcgtcttcctctccttcgacttcaacactggcctgtgggacaccgctgacgccgcggctgtcggcgcccgcatcgctgcattcggcagccgcggtggccagctgaaggttgacgacaaggcgtttgtctcttcttttgttggcgatgcgctcgatgtctcggccgtgaggacggcagccggcattgacatcttctttgccccgaacttcaaccccggcggcggtgcggattggactcagttggacggcgcgttcagttggtgggtcgaggccctgagaggcgattgccggttgtgctgacgacggggcaggtatgcttggccaaccgacggttccaacaaccctccttcctccaccagcacctacctgcccacctatgccgacaccgactacaccaccaagctgggcggcgacaagacgaaatacgtagcccgtaagtgcatagccccttcgcacgccgccatcgcagccactgacccgtgcagccgtgtcgccctggttcttcacgcactacggcagcgaggtgtccttcggccccaagaactatgtaagccaccccgcccgacgacgaccccatcgacctgcccactaaccctctctcgcgccagctcttcccctccgagttcctctggttcacgcgctggcaagagatccttgacctcgggtcgcgcttcgtcgaaatcatcacctggaacggtaagccactgcctcccgcccacctcccaccgccccgccatactcaccccctctccttagactacggcgagtcgcactacatcggcccgctctcctccccgcactacgacgacggcaacagcaaatggaccaacgacatgccgcacaacggctgggccgacctcgccgccccctacatcgccgcctacaaagccggcgccacctcgcccacctcctacatcaccactgacaggctggtctactggttccgcccgcagccgaaaggcctcgactgcgcctcgaccgacaacgtcggcgccgcgccctctggcgccgacctcgtcgccgacaagctgttcgtcgtgacgatgctgacggacgccgcgaacgtgacggtcggatcgggcggcgatgccacgcagacgttcgccgcgccgaagggcgtcgccagctttacggtgccgctggccgtgggcgtgcaggcgttcgcggtcgagcgcggcggcgtcgccgtcgacggcctaggcgggcaggcgccgaagcaggtcagcggcgagtgtgtgtgcgggctgtacaacttcaatgcgttcgtcggcaccctgccggtcgcggagcagggcgacgcgttgcaggccgatgggctgagcaggttcaccgagggcttgaaggtcgcgacgtgcagtccgacgccgacgttggccgccaggcggtgaggtgcttggggcttggtgggaggctgtgacatggtccgggttcggcgaggggaccgtctggctaatggaggaggtgtcgcactcgggtgttatctgccgaggatgcgaagcctatcaaccgcctgaattgtattctattgttggatgtat

SEQ ID NO: 218 - DNA, 1485 bp, M. phaseolina
atgcgctgggcctcgactctgctgccgtccgccaccggcgcgctgctcttcgctgccctggcaaatggcgctcccgcagtcggctccgccgccacgcccacgctgaaggagaggcagacgtccgacagattagtcttcgcccatttcatgatcggcatctcgaccgaccgcaccagctccgccgattacgacgccgacatcctgcgtgccaaatctctaggcattgacgccttcgctctcaacttcggccccgacaccgccagcgccaactacagccagcaactcgtgtacgcctatgagtcggccgccaacaacggcttcagcgtcttcctctccttcgacttcaacactggcctgtgggacaccgctgacgccgcggctgtcggcgcccgcatcgctgcattcggcagccgcggtggccagctgaaggttgacgacaaggcgtttgtctcttcttttgttggcgatgcgctcgatgtctcggccgtgaggacggcagccggcattgacatcttctttgccccgaacttcaaccccggcggcggtgcggattggactcagttggacggcgcgttcagttggtatgcttggccaaccgacggttccaacaaccctccttcctccaccagcacctacctgcccacctatgccgacaccgactacaccaccaagctgggcggcgacaagacgaaatacgtagcccccgtgtcgccctggttcttcacgcactacggcagcgaggtgtccttcggccccaagaactatctcttcccctccgagttcctctggttcacgcgctggcaagagatccttgacctcgggtcgcgcttcgtcgaaatcatcacctggaacgactacggcgagtcgcactacatcggcccgctctcctccccgcactacgacgacggcaacagcaaatggaccaacgacatgccgcacaacggctgggccgacctcgccgccccctacatcgccgcctacaaagccggcgccacctcgcccacctcctacatcaccactgacaggctggtctactggttccgcccgcagccgaaaggcctcgactgcgcctcgaccgacaacgtcggcgccgcgccctctggcgccgacctcgtcgccgacaagctgttcgtcgtgacgatgctgacggacgccgcgaacgtgacggtcggatcgggcggcgatgccacgcagacgttcgccgcgccgaagggcgtcgccagctttacggtgccgctggccgtgggcgtgcaggcgttcgcggtcgagcgcggcggcgtcgccgtcgacggcctaggcgggcaggcgccgaagcaggtcagcggcgagtgtgtgtgcgggctgtacaacttcaatgcgttcgtcggcaccctgccggtcgcggagcagggcgacgcgttgcaggccgatgggctgagcaggttcaccgagggcttgaaggtcgcgacgtgcagtccgacgccgacgttggccgccaggcggtga

SEQ ID NO: 219 - protein, 494 aa, M. phaseolina
MRWASTLLPSATGALLFAALANGAPAVGSAATPTLKERQTSDRLVFAHFMIGISTDRTSSADYDADILRAKSLGIDAFALNFGPDTASANYSQQLVYAYESAANNGFSVFLSFDFNTGLWDTADAAAVGARIAAFGSRGGQLKVDDKAFVSSFVGDALDVSAVRTAAGIDIFFAPNFNPGGGADWTQLDGAFSWYAWPTDGSNNPPSSTSTYLPTYADTDYTTKLGGDKTKYVAPVSPWFFTHYGSEVSFGPKNYLFPSEFLWFTRWQEILDLGSRFVEIITWNDYGESHYIGPLSSPHYDDGNSKWTNDMPHNGWADLAAPYIAAYKAGATSPTSYITTDRLVYWFRPQPKGLDCASTDNVGAAPSGADLVADKLFVVTMLTDAANVTVGSGGDATQTFAAPKGVASFTVPLAVGVQAFAVERGGVAVDGLGGQAPKQVSGECVCGLYNFNAFVGTLPVAEQGDALQADGLSRFTEGLKVATCSPTPTLAARR

SEQ ID NO: 220 - DNA, 1948 bp, M. phaseolina
cacgagactctcactaatctccacttcaagggtcagtctctgctcaactcctctgctctgactttttttttatgcgccctcattctgcatttttttttttcgggtgttgctgtttgtcttcgttgctttctgactttgcgcactgtcaacatgcgtgctcacactctgcagtgcttggcagcagccgcagcagctttgctttatggcagccaagtcgttgctgaagaccccaaagcagtgtttgctcattacatggtttgtcgcttcgctcacactgccaaagggttctctgctgacaggcattccaggtcggcacaataaacgaggatcatgtccatcaagatgtcgacgatgccgccgccatggggctagacggcttcgcgctcaacatgggaagtcctttggaaccgttctctcgcgccgtgttcgactacatgtttgattacacccgcgacaaccatcccgacttcaagctattcataagtatggatctctggtccgcaaagaacctgtccgacttcgatcagttcttcaccgactttctggcccacgatgcctattacaaaggtcccaacggattccctttcgtcagcacctatggcaacggtggattctccaaggaaacatggcaagactggaagaataggtgggcggacaagctctactttgtacccgattttgccggcatggcagggacagatgattcctctcctgagtggtgggaggactggggggacatcgtcgacggcctattcagctgggaatcggtatggcccgtccagaaccagaccaacaccctgagcatcgctgcagacgacaagcacatggccgctgcctcccagaacaacaagacatacatgatcggtaggtcaaccctgaggcttccctctctcgcctcagctactgatatacctccctccacgtaggtctcagcatgctccaatacaaaaactcctacggcgccaacctgtaccgcgccggcgaggagaacctttctaaccgcatccacaacatcctcaacatgacgaccaagcccgccttcgcgcagctgctcacctggaacgacgggcccgaatcccactacatcggcaccatctggcccgagcagaacaacgacaccatcccctccgtctacgcctcccaatccgccgcctcccacaccggcatccaatccgttctcacgagcttcatcgacgcctacaaaaaggacctcccctcccccgacatgcagccgcaggaagacaagcaggctgtcggcgcgctgtggtacaagcccatcctctccaacaccgtctgcgccaacgagatgagcggcgagctgcacgacgccaagcctgacggctacgaagtcgccgccgatgtctccgcctgggccgtcgtcgtcgccgccgatgccgaggccgacgacctcaccctgcgcgggtacagcggcggcgagaagctcggcgaggtggcgctcgtgcccgggctcaacttcggcaatttcagcacgctgaaggagggaaagcagtgcatggaagtcaggaatggacaggggaggctcgtgctcgtcgccagtggtggcagggacgtcacgagtgattgtcctgacgggattttcaatcttaatccgcagattttggaactgggcgaggacgtcagccaagggggctgtaccgggggcgatgatgatggcgatgcgagcggaagtggtgatggtgacggtgaggagagttggggtgtcagaggcaccatgctggataagtggcggttggtggcggcgttgatggtgtcgtcggcggtggtgtggctgtggtgagtagtgcgtcgggaatttttcccgttgcttttgatgaagatatgattatgcggttatgattatttactccctctgcttggaacggcggtggaaaggggaaaagtatgattaagggcaggcatttggtatgagctctgcttcttgtttatt

SEQ ID NO: 221 - DNA, 1533 bp, M. phaseolina
atgcgtgctcacactctgcagtgcttggcagcagccgcagcagctttgctttatggcagccaagtcgttgctgaagaccccaaagcagtgtttgctcattacatggtcggcacaataaacgaggatcatgtccatcaagatgtcgacgatgccgccgccatggggctagacggcttcgcgctcaacatgggaagtcctttggaaccgttctctcgcgccgtgttcgactacatgtttgattacacccgcgacaaccatcccgacttcaagctattcataagtatggatctctggtccgcaaagaacctgtccgacttcgatcagttcttcaccgactttctggcccacgatgcctattacaaaggtcccaacggattccctttcgtcagcacctatggcaacggtggattctccaaggaaacatggcaagactggaagaataggtgggcggacaagctctactttgtacccgattttgccggcatggcagggacagatgattcctctcctgagtggtgggaggactggggggacatcgtcgacggcctattcagctgggaatcggtatggcccgtccagaaccagaccaacaccctgagcatcgctgcagacgacaagcacatggccgctgcctcccagaacaacaagacatacatgatcggtctcagcatgctccaatacaaaaactcctacggcgccaacctgtaccgcgccggcgaggagaacctttctaaccgcatccacaacatcctcaacatgacgaccaagcccgccttcgcgcagctgctcacctggaacgacgggcccgaatcccactacatcggcaccatctggcccgagcagaacaacgacaccatcccctccgtctacgcctcccaatccgccgcctcccacaccggcatccaatccgttctcacgagcttcatcgacgcctacaaaaaggacctcccctcccccgacatgcagccgcaggaagacaagcaggctgtcggcgcgctgtggtacaagcccatcctctccaacaccgtctgcgccaacgagatgagcggcgagctgcacgacgccaagcctgacggctacgaagtcgccgccgatgtctccgcctgggccgtcgtcgtcgccgccgatgccgaggccgacgacctcaccctgcgcgggtacagcggcggcgagaagctcggcgaggtggcgctcgtgcccgggctcaacttcggcaatttcagcacgctgaaggagggaaagcagtgcatggaagtcaggaatggacaggggaggctcgtgctcgtcgccagtggtggcagggacgtcacgagtgattgtcctgacgggattttcaatcttaatccgcagattttggaactgggcgaggacgtcagccaagggggctgtaccgggggcgatgatgatggcgatgcgagcggaagtggtgatggtgacggtgaggagagttggggtgtcagaggcaccatgctggataagtggcggttggtggcggcgttgatggtgtcgtcggcggtggtgtggctgtggtga

SEQ ID NO: 222 - protein, 510 aa, M. phaseolina
MRAHTLQCLAAAAAALLYGSQVVAEDPKAVFAHYMVGTINEDHVHQDVDDAAAMGLDGFALNMGSPLEPFSRAVFDYMFDYTRDNHPDFKLFISMDLWSAKNLSDFDQFFTDFLAHDAYYKGPNGFPFVSTYGNGGFSKETWQDWKNRWADKLYFVPDFAGMAGTDDSSPEWWEDWGDIVDGLFSWESVWPVQNQTNTLSIAADDKHMAAASQNNKTYMIGLSMLQYKNSYGANLYRAGEENLSNRIHNILNMTTKPAFAQLLTWNDGPESHYIGTIWPEQNNDTIPSVYASQSAASHTGIQSVLTSFIDAYKKDLPSPDMQPQEDKQAVGALWYKPILSNTVCANEMSGELHDAKPDGYEVAADVSAWAVVVAADAEADDLTLRGYSGGEKLGEVALVPGLNFGNFSTLKEGKQCMEVRNGQGRLVLVASGGRDVTSDCPDGIFNLNPQILELGEDVSQGGCTGGDDDGDASGSGDGDGEESWGVRGTMLDKWRLVAALMVSSAVVWLW

SEQ ID NO: 223 - DNA, 1699 bp, M. phaseolina
gctattttgggtaaccctgatgccgaaaaatggactgcgacctcgctacggctctcatataaattctgccagaaagttcctgcaactttcttgctccatcagctcgtccagctctcatccccctcaagaagctgccagtaacttcccgccatgaagctttccaccatctttgccactctggctgctctggccggcgaggccactgccaaagctgtcttcgctcacttcatggtatgcatccgtccacgaacctgaattagtcagtcctgagctaagaactatacaggtcggcaacgtcataaacaattacgacgttgacaagtggacgagcgatatcaagcttgcccaggcctccggcatcgatggcttcgtcctcaacatcaccccgcccttgaacgaggctttgcggactcagatcgctgccgccttcattgcagcgaataacctgaagagcgagtggaagaacttcttctccttcgactacttaggtaacgggatcccgtggaacgctgccgacattgcctctctcatgaaggagtacggaccgaattacgcctatcagaaggcctccagaaacggcgtgagcctgcctttcgtttcgaccttcgagggcggcgaccacgccggtgattgggcctccatcaagtctcaagttgacgtctatctcgtgcccgattggaccggctcgggcgctgatgtggtgaaggcaaacatcaacgcgggcgccagcattgacggctttttcagctgggacatgtggcccgaaggtgctaacgacatgagcaccacgcctgacaagagctggcagtccaccattggcgacaaggactatatgatgggcgtctcaccctggttcttcaccgacctcaagggctatgggaagcagcgcctctggcgcggcgacgacctctgggccgaccgctgggagcaagtccagcaagtcaaccccgagtgggtcgagatcgttacctggaacgactacggcgagtctcactacatcggccccatctgggaagccggcattccacaggacgcctccgccaacgccgacgcccgctggtacgtcgagggctacggccaccagcactggcgcgatctcctcccttactacatcgcccgctacaagaacggcagcccgcccgcagtgacccaggagaagctcacctggtggtaccgcctctctcccaaggcagccggcactacccaggttaccggcaacgattgctcctaccagccctgccttgaccccaacgccattgttcaggatgagatcttcttcaccgcgctgatcagcgaccctgccaacaccaacatcgttgtccaggtcggcgacaacacgcctgtatcccaccccgccaccgccgtcggcatcaaccatttctcgcagcccttcaacggacagtacggcaacgtgactttttcgattgtgaggaacggaaggggcgttctttcgggtacgggctacgcaatcacagctcagccgccgaacggaaagaggaactacaacgcgtatgtcggtggtgttccggatacctacgcaagcttgtgagccatctccaaacgagggcaagaggatggccagaaagaaagaatgtatatatgcgtgatccagaggaattagaaaggacattcgctacatagaccaatgaatacaaggcaagccttgccaattttgccaatgagcttggaagctttgtgg

SEQ ID NO: 224 - DNA, 1344 bp, M. phaseolina
atgaagctttccaccatctttgccactctggctgctctggccggcgaggccactgccaaagctgtcttcgctcacttcatggtcggcaacgtcataaacaattacgacgttgacaagtggacgagcgatatcaagcttgcccaggcctccggcatcgatggcttcgtcctcaacatcaccccgcccttgaacgaggctttgcggactcagatcgctgccgccttcattgcagcgaataacctgaagagcgagtggaagaacttcttctccttcgactacttaggtaacgggatcccgtggaacgctgccgacattgcctctctcatgaaggagtacggaccgaattacgcctatcagaaggcctccagaaacggcgtgagcctgcctttcgtttcgaccttcgagggcggcgaccacgccggtgattgggcctccatcaagtctcaagttgacgtctatctcgtgcccgattggaccggctcgggcgctgatgtggtgaaggcaaacatcaacgcgggcgccagcattgacggctttttcagctgggacatgtggcccgaaggtgctaacgacatgagcaccacgcctgacaagagctggcagtccaccattggcgacaaggactatatgatgggcgtctcaccctggttcttcaccgacctcaagggctatgggaagcagcgcctctggcgcggcgacgacctctgggccgaccgctgggagcaagtccagcaagtcaaccccgagtgggtcgagatcgttacctggaacgactacggcgagtctcactacatcggccccatctgggaagccggcattccacaggacgcctccgccaacgccgacgcccgctggtacgtcgagggctacggccaccagcactggcgcgatctcctcccttactacatcgcccgctacaagaacggcagcccgcccgcagtgacccaggagaagctcacctggtggtaccgcctctctcccaaggcagccggcactacccaggttaccggcaacgattgctcctaccagccctgccttgaccccaacgccattgttcaggatgagatcttcttcaccgcgctgatcagcgaccctgccaacaccaacatcgttgtccaggtcggcgacaacacgcctgtatcccaccccgccaccgccgtcggcatcaaccatttctcgcagcccttcaacggacagtacggcaacgtgactttttcgattgtgaggaacggaaggggcgttctttcgggtacgggctacgcaatcacagctcagccgccgaacggaaagaggaactacaacgcgtatgtcggtggtgttccggatacctacgcaagcttgtga

SEQ ID NO: 225 - protein, 447 aa, M. phaseolina
MKLSTIFATLAALAGEATAKAVFAHFMVGNVINNYDVDKWTSDIKLAQASGIDGFVLNITPPLNEALRTQIAAAFIAANNLKSEWKNFFSFDYLGNGIPWNAADIASLMKEYGPNYAYQKASRNGVSLPFVSTFEGGDHAGDWASIKSQVDVYLVPDWTGSGADVVKANINAGASIDGFFSWDMWPEGANDMSTTPDKSWQSTIGDKDYMMGVSPWFFTDLKGYGKQRLWRGDDLWADRWEQVQQVNPEWVEIVTWNDYGESHYIGPIWEAGIPQDASANADARWYVEGYGHQHWRDLLPYYIARYKNGSPPAVTQEKLTWWYRLSPKAAGTTQVTGNDCSYQPCLDPNAIVQDEIFFTALISDPANTNIVVQVGDNTPVSHPATAVGINHFSQPFNGQYGNVTFSIVRNGRGVLSGTGYAITAQPPNGKRNYNAYVGGVPDTYASL

SEQ ID NO: 226 - DNA, 1767 bp, M. phaseolina
agtttcagcttcaccttcggctggtacctctctcaacacatccgtcactggactgacgcggcagcggtgcataacccttcctttgctacacccattgctccttcgagggctgtccgatccttttttgagtagtcactccttgcttgcatcatgcgttccttctccagctatctggtcgctctggccacggcatccctgggccttgtcgccagcgtcaatgccgattccaagggtgtctttgcccactacatggtgtgtctcgagccatccggcccagcttgcactcttgctgacataagccaggtgtgcggtctctcgtccgtcgagcaggctcagaccgacgtccgcgacgccaagaatctcggtgttgatgcctttgctctgaatgtccagaatgtcgtcgactcctgggcaaccggcgccattgagtacctcttcactgccgcagcccagaatgacttccacctgttcttttccttcgacatggccgtcctgaacgagcaggatcccacctccttccttcccatcttcgagcagtatgcttcaaacgacacttactacaagcacgatggcaagcctttcgtttccaccttcaacggcggcatcatgcagaacggcggcgagtggaccaggaagttccgcgaggcgattgaggccgacaacattaccccctacttcgtctccgactttggcctctacagcagctccagcgcttctgctagcgagagcatcatgggttccctgagcacctattctgccgtcgacggtgtcttcagctgggagactgcctggccctcccagaacgatggccttgccagcatcctcagctccgtcaccgacaaggtcggctcggacgctgcccatgctaccggcaagtcctacttgatgcgtacgtccacctcgtctccctaaccaccgctctccgctgactccgccacagctctctcctcccaccagttcaagcacattgacggccttggcaactggtaccgccgcggcgaactcaccctcccgaaccgcatgaagcagatcctcgagctctctcccgagttcgtcatgcttctcacctggaacgatgccggcgagtcgcactacatcggcaacgtctggcaagagtccatctcgacctcggaggccaccaagaaatacgtcgacgattttgaccactcggcctggcaggacgtcatctcgcccttcatctccgcatacaagaacgacgccaaggatgagaccgagatcctgcctctcaacaacggcaacttcaccggcgccatgtggtaccgtcccctgctcaaggatgcctcttgctccggtgactacctcggcaagcccatcggctgggagaacgcgcaggacaccgtcaacttcgccatcgtgctgcccgccgagacttccggcgttaagatcaatgtgtacagcggcgacaccctcctcaagtcgttcgacggcaaggccggcatgaacgcccaggccgtccagggcatgcgggcgggtgcgcagaaggtcgaggtagtgggtgcggatggcaacgtgatcggcgcgggcttgagcaaggtggatgtcgccgcggatgctgacttttgcaacttcaactatcacgtcgtccacgtggcgtaaggaacaggcgcaacatgggatgatgtctgataccccctgttttttttagacttcttacattcgtttctgctggttccccaaatggggatacctgcttttcttttcatttctccaactcaagaattctagacttttacattttactcttct

SEQ ID NO: 227 - DNA, 1365 bp, M. phaseolina
atgcgttccttctccagctatctggtcgctctggccacggcatccctgggccttgtcgccagcgtcaatgccgattccaagggtgtctttgcccactacatggtgtgcggtctctcgtccgtcgagcaggctcagaccgacgtccgcgacgccaagaatctcggtgttgatgcctttgctctgaatgtccagaatgtcgtcgactcctgggcaaccggcgccattgagtacctcttcactgccgcagcccagaatgacttccacctgttcttttccttcgacatggccgtcctgaacgagcaggatcccacctccttccttcccatcttcgagcagtatgcttcaaacgacacttactacaagcacgatggcaagcctttcgtttccaccttcaacggcggcatcatgcagaacggcggcgagtggaccaggaagttccgcgaggcgattgaggccgacaacattaccccctacttcgtctccgactttggcctctacagcagctccagcgcttctgctagcgagagcatcatgggttccctgagcacctattctgccgtcgacggtgtcttcagctgggagactgcctggccctcccagaacgatggccttgccagcatcctcagctccgtcaccgacaaggtcggctcggacgctgcccatgctaccggcaagtcctacttgatgcctctctcctcccaccagttcaagcacattgacggccttggcaactggtaccgccgcggcgaactcaccctcccgaaccgcatgaagcagatcctcgagctctctcccgagttcgtcatgcttctcacctggaacgatgccggcgagtcgcactacatcggcaacgtctggcaagagtccatctcgacctcggaggccaccaagaaatacgtcgacgattttgaccactcggcctggcaggacgtcatctcgcccttcatctccgcatacaagaacgacgccaaggatgagaccgagatcctgcctctcaacaacggcaacttcaccggcgccatgtggtaccgtcccctgctcaaggatgcctcttgctccggtgactacctcggcaagcccatcggctgggagaacgcgcaggacaccgtcaacttcgccatcgtgctgcccgccgagacttccggcgttaagatcaatgtgtacagcggcgacaccctcctcaagtcgttcgacggcaaggccggcatgaacgcccaggccgtccagggcatgcgggcgggtgcgcagaaggtcgaggtagtgggtgcggatggcaacgtgatcggcgcgggcttgagcaaggtggatgtcgccgcggatgctgacttttgcaacttcaactatcacgtcgtccacgtggcgtaa

SEQ ID NO: 228 - protein, 454 aa, M. phaseolina
MRSFSSYLVALATASLGLVASVNADSKGVFAHYMVCGLSSVEQAQTDVRDAKNLGVDAFALNVQNVVDSWATGAIEYLFTAAAQNDFHLFFSFDMAVLNEQDPTSFLPIFEQYASNDTYYKHDGKPFVSTFNGGIMQNGGEWTRKFREAIEADNITPYFVSDFGLYSSSSASASESIMGSLSTYSAVDGVFSWETAWPSQNDGLASILSSVTDKVGSDAAHATGKSYLMPLSSHQFKHIDGLGNWYRRGELTLPNRMKQILELSPEFVMLLTWNDAGESHYIGNVWQESISTSEATKKYVDDFDHSAWQDVISPFISAYKNDAKDETEILPLNNGNFTGAMWYRPLLKDASCSGDYLGKPIGWENAQDTVNFAIVLPAETSGVKINVYSGDTLLKSFDGKAGMNAQAVQGMRAGAQKVEVVGADGNVIGAGLSKVDVAADADFCNFNYHVVHVA

SEQ ID NO: 229 - DNA, 1065 bp, M. phaseolina
ggtggtgttgctgcctcagcggaacccgccggccatcactcgccaagtccgtggccatggaggtgtgtgggagcactcgaggagctgtacaaaaggcgatactacatccgttcatattgccatcaagcaaacgatctcctattcatcatcatggctctcaatcgcggcttcatggctgcgttagcatcctttcttgtcctcactaccgcagatttgggagcggctaaggccgtaactaggggtgtctttgcaaaatacatggttggaaacgtgtacgaagaccatgctcaccaagacatcaaagatgcttcagccatgggccttgacggattcgccctgaacattggcgacccctcccaagatttcgtacgccagacgctgaactacatgttcgactacgcccgcgacaactaccccgacttcaagctcttcatcagcatggatctttgggccgccggctccgccaagaaaggcttgaatgacttcgtcggtatccttagggactacatgggtcatggagcttactacaaacgcccaaatgggtatccctttattagcacctttgccgatggcggcctcgaaaacacgacatggatggactggaggaacaagtgggcaaacgaaatttacttcgtacccgactttggcggctcaaaagcctactgcctgtctgaccctggctggtgggagtactggggagatgttgtcgatggcatcttcagctgggaatctacttggcctctgcgaggcagcactcaaacatcttactggaagaacgagacgtggatttcgtccacgtgcagcttccaccgactaacattcggctttctaggcttgagcatgctgcaatacgagaactcggtggggtttttgctccgacttgagcctcaagcgctgaccacgtggtcgatatagcatgagacgaatctataccgagctttttttttaaagcaatattctttttgaagaaaaggaagagttctatttaaaagcaaactattagttatagttaaaaaataattttaaagaataactaacctttttagtagaagctttcttccctta

SEQ ID NO: 230 - DNA, 765 bp, M. phaseolina
atggctctcaatcgcggcttcatggctgcgttagcatcctttcttgtcctcactaccgcagatttgggagcggctaaggccgtaactaggggtgtctttgcaaaatacatggttggaaacgtgtacgaagaccatgctcaccaagacatcaaagatgcttcagccatgggccttgacggattcgccctgaacattggcgacccctcccaagatttcgtacgccagacgctgaactacatgttcgactacgcccgcgacaactaccccgacttcaagctcttcatcagcatggatctttgggccgccggctccgccaagaaaggcttgaatgacttcgtcggtatccttagggactacatgggtcatggagcttactacaaacgcccaaatgggtatccctttattagcacctttgccgatggcggcctcgaaaacacgacatggatggactggaggaacaagtgggcaaacgaaatttacttcgtacccgactttggcggctcaaaagcctactgcctgtctgaccctggctggtgggagtactggggagatgttgtcgatggcatcttcagctgggaatctacttggcctctgcgaggcagcactcaaacatcttactggaagaacgagacgtggatttcgtccacgtgcagcttccaccgactaacattcggctttctaggcttgagcatgctgcaatacgagaactcggtggggtttttgctccgacttgagcctcaagcgctgaccacgtggtcgatatag

SEQ ID NO: 231 - protein, 254 aa, M. phaseolina
MALNRGFMAALASFLVLTTADLGAAKAVTRGVFAKYMVGNVYEDHAHQDIKDASAMGLDGFALNIGDPSQDFVRQTLNYMFDYARDNYPDFKLFISMDLWAAGSAKKGLNDFVGILRDYMGHGAYYKRPNGYPFISTFADGGLENTTWMDWRNKWANEIYFVPDFGGSKAYCLSDPGWWEYWGDVVDGIFSWESTWPLRGSTQTSYWKNETWISSTCSFHRLTFGFLGLSMLQYENSVGFLLRLEPQALTTWSI

SEQ ID NO: 232 - DNA, 1839 bp, M. phaseolina
aaggccagggcacccgctcgctgcagctcccaacgcgggaacccgcgccgcgcccagtcggcttgtcggaagtacgagcgtcttcaacgcgacttgtctccagaataaataccactccaccgtcgcccgtcgcaatggcccccatcaaccatggaccgcctggagagtttctggaagaagagcaagcgcgaggtgcagggcgtgctggaggacgtcggtctgcgcgactcgcgccctgacgactcccacgcccagcctccaccaccacctttcgagtcgcacccaagcctccagttccacgataggcgtccccagctcgaccactgccaccatgactgccgccgccgccgcaagggcatcttctgccactacatggtattctttggccccactcccgtgcaatcagcgagtggctaatcggccccgcaggtgggcagcatgggcagcattgagcaggcccacactgacgtgcgagaggccaaagccgtcggcttcgatgccttcgtgttgaacgtgcagaatgtaaaggacgattggtcgttgactgccctctcgtgggtcttctccgccgccgaggccgccgacttcaagctctttttctccttcgacatggacgtcctcgccgaccccgtcgatttcctgccgctcttcgtgcactatcaagcccatccggcctactatcgctaccaggggctcccgttcgtcagcaccttccaaggaggccgcaagagcttcgacctcccgcatcccaatgagggctggacgcttaagttccgagctcagctgcaggaccgttacggaatcattcccttcttcgtgcccgatttcgacgaccatggtggagccgcatatgacgaccatttcttcagccgttaccccgtcgtggacggtgttttcagctgggagacagcgtggccgttcaaggatgacggcgtcagtgacgtaagctcggctgctgatgaaattggcatgaactgcgcccataatgccagcaaggtgtacatgatgcctatgtccacactccagttcaaacgcatagacggcagcggcaattggtatcgacgtggcgagctcaacctcgcccagagaatggcccaggtgctcgcgctttctccagattttgtgcagataatctcgtggaacgacgcaggcgagagtcactatattggaaacgtctggcctgagggtattgccagttgcccggatattggcctttacaccgatggctatgatcataaggcctggctgcatattatcgctcccttcatcgccgcctacaaagccggggccacggatccctcccagatcctgccctttggtgattttgcaggtgcattctggtaccgtgaccgcctggctgatactcattgccctggtgatagcatgggcaaacccagtggctgtgagaacgcagaggatgctatcaatcttgccattctccttcctgcggacacccagggcgtcggtatcaacgtctggagcggcggtgagctcctcgcctctatacctgggcagccaggcctaaatgcccactgcgttaaaggagcgaagacgggtccgcaaagggtggagcttatcaaggatggccatattccaatgggcgccggagacggccctgtcaatatcaccgcagacgcagacgaaggcaagacctacaacttcaattatcacgtggtacatatctcttgagcaaactttacgatctttccttagcttaaaaaaacctaaaatatctgtattcaaacaatctggagaaccaatgaaaggcatgaatagagctctggctaaggagcgcgcatcagcgagcacatgtaactatacagtcaagctgagttggtc

SEQ ID NO: 233 - DNA, 1485 bp, M. phaseolina
atggaccgcctggagagtttctggaagaagagcaagcgcgaggtgcagggcgtgctggaggacgtcggtctgcgcgactcgcgccctgacgactcccacgcccagcctccaccaccacctttcgagtcgcacccaagcctccagttccacgataggcgtccccagctcgaccactgccaccatgactgccgccgccgccgcaagggcatcttctgccactacatggtgggcagcatgggcagcattgagcaggcccacactgacgtgcgagaggccaaagccgtcggcttcgatgccttcgtgttgaacgtgcagaatgtaaaggacgattggtcgttgactgccctctcgtgggtcttctccgccgccgaggccgccgacttcaagctctttttctccttcgacatggacgtcctcgccgaccccgtcgatttcctgccgctcttcgtgcactatcaagcccatccggcctactatcgctaccaggggctcccgttcgtcagcaccttccaaggaggccgcaagagcttcgacctcccgcatcccaatgagggctggacgcttaagttccgagctcagctgcaggaccgttacggaatcattcccttcttcgtgcccgatttcgacgaccatggtggagccgcatatgacgaccatttcttcagccgttaccccgtcgtggacggtgttttcagctgggagacagcgtggccgttcaaggatgacggcgtcagtgacgtaagctcggctgctgatgaaattggcatgaactgcgcccataatgccagcaaggtgtacatgatgcctatgtccacactccagttcaaacgcatagacggcagcggcaattggtatcgacgtggcgagctcaacctcgcccagagaatggcccaggtgctcgcgctttctccagattttgtgcagataatctcgtggaacgacgcaggcgagagtcactatattggaaacgtctggcctgagggtattgccagttgcccggatattggcctttacaccgatggctatgatcataaggcctggctgcatattatcgctcccttcatcgccgcctacaaagccggggccacggatccctcccagatcctgccctttggtgattttgcaggtgcattctggtaccgtgaccgcctggctgatactcattgccctggtgatagcatgggcaaacccagtggctgtgagaacgcagaggatgctatcaatcttgccattctccttcctgcggacacccagggcgtcggtatcaacgtctggagcggcggtgagctcctcgcctctatacctgggcagccaggcctaaatgcccactgcgttaaaggagcgaagacgggtccgcaaagggtggagcttatcaaggatggccatattccaatgggcgccggagacggccctgtcaatatcaccgcagacgcagacgaaggcaagacctacaacttcaattatcacgtggtacatatctcttga

SEQ ID NO: 234 - protein, 494 aa, M. phaseolina
MDRLESFWKKSKREVQGVLEDVGLRDSRPDDSHAQPPPPPFESHPSLQFHDRRPQLDHCHHDCRRRRKGIFCHYMVGSMGSIEQAHTDVREAKAVGFDAFVLNVQNVKDDWSLTALSWVFSAAEAADFKLFFSFDMDVLADPVDFLPLFVHYQAHPAYYRYQGLPFVSTFQGGRKSFDLPHPNEGWTLKFRAQLQDRYGIIPFFVPDFDDHGGAAYDDHFFSRYPVVDGVFSWETAWPFKDDGVSDVSSAADEIGMNCAHNASKVYMMPMSTLQFKRIDGSGNWYRRGELNLAQRMAQVLALSPDFVQIISWNDAGESHYIGNVWPEGIASCPDIGLYTDGYDHKAWLHIIAPFIAAYKAGATDPSQILPFGDFAGAFWYRDRLADTHCPGDSMGKPSGCENAEDAINLAILLPADTQGVGINVWSGGELLASIPGQPGLNAHCVKGAKTGPQRVELIKDGHIPMGAGDGPVNITADADEGKTYNFNYHVVHIS

SEQ ID NO: 235 - DNA, 1972 bp, M. phaseolina
catgggggccgcttccgtgatttgttggaaatctgggtgtcgcagtggctggacaggagatgcggtgggacgctttttctttgttcttttttaaacttcgccctgttctgctttctttcttttatccgacaccttaaattcacttacattatgcggttatcccggcgcttagccgccgctacggcaggccttctctatgcggacatagtggccgctgtagcttccaaagccgtcttcgcgcattacatggttggttcgcctccagaccgctttccagcgataagtgagcttacgcatgcaaggtggggaccgtcttcgaggaccatgtcaagcaagatgtcgacgatgcagcggccatgggtctcgatggcttcgcgctcaatgtcggggacccgactgggtctgaaactcgaacgctgctgggcaacatcatggactatgctgccagcagccactcggatttcaagttcttcatcagcatggacttgttctcgcccaagaatctgtccgatttcgatcagatactgacggactttctgggacacgaagcatactacaagggctccgatggatatcccttcgtcagcacttatggaagcggcgaattcgatgagaacgtctggagcgactggcgggacaaatgggcagataaaatatatttcgtgcctgactttgccgacgccatggctctggagggatccgatggctggtgggacaagtggggagcgttgattgctggcctattcagctgggagagcacgtggccggcgagaggacaggcggcgacattccaggctgttgaagtggataagaagcctgagtggactaagcaaagaaacaaggcatacatgattggtaggcaccggccacctctcctgattcagagaccaattccatacttaccatctgggttgcaggcttgagtatgctacaatacaagaattcctacggcgcgaacatctaccgcgccggcgaagagaacctcccgctgcggatgagcaacatcctcgacatggacgaccggcccgacttcacacaaatcctcacatgggtacgtcacatccccaactgcctctcagccaaatccactgactttttcccccagaacgacgggcccgaaagccactacatcggcaacatttggcctgagcaagacaacactaccgaaatgcggcggtacgccaacgacgacgcgccccacaaagccatccagcccatcctcagctccttcatcaccgccttcaaatccggcgcctcttcgcaggaaatggcgccgcccggcaacgccagggccgccggctcgctatggttcaagcctatcctcgccaacacatcctgcccgcaggacaacgacctgcacagcggcaagcccgacggctacgaggttgccgtcgacgtctcttcctgggccgtcgtcgtcagcgataatggcgggaacatgacgctgcacggattcagcgacggtgaggagatcggatccgcagacctcgtcgctggattgaactttgggaactttagcgctatgcgggagggtccacagtgcatggaggtgcggagcgagcacggtggattggttgcggtggcaaagggcgggaggaatgtgacgtcggactgccccgacgggatttacaacctgaatccgcagatcctgcagctggtcagtgatgattcggtgggcgggtgcgcgagctcgaagagctcttcgtcagatgatgatgatgatgactcgggaagtgtgctggccgttatgctggacagatacgtcttctggactgcgcttcttgcatccttggcctctgttacaggtgtcgttggactctgaggaaaatgaaggaatgaaatgtattaatacggcgtttttgacacaccctgaggaatagagggattagagacacatcgtggactcgttctcgcggcatgccacatggaaaacagcaccatcatgatattttagtatttctctttcacgtca

SEQ ID NO: 236 - DNA, 1503 bp, M. phaseolina
atgcggttatcccggcgcttagccgccgctacggcaggccttctctatgcggacatagtggccgctgtagcttccaaagccgtcttcgcgcattacatggtggggaccgtcttcgaggaccatgtcaagcaagatgtcgacgatgcagcggccatgggtctcgatggcttcgcgctcaatgtcggggacccgactgggtctgaaactcgaacgctgctgggcaacatcatggactatgctgccagcagccactcggatttcaagttcttcatcagcatggacttgttctcgcccaagaatctgtccgatttcgatcagatactgacggactttctgggacacgaagcatactacaagggctccgatggatatcccttcgtcagcacttatggaagcggcgaattcgatgagaacgtctggagcgactggcgggacaaatgggcagataaaatatatttcgtgcctgactttgccgacgccatggctctggagggatccgatggctggtgggacaagtggggagcgttgattgctggcctattcagctgggagagcacgtggccggcgagaggacaggcggcgacattccaggctgttgaagtggataagaagcctgagtggactaagcaaagaaacaaggcatacatgattggcttgagtatgctacaatacaagaattcctacggcgcgaacatctaccgcgccggcgaagagaacctcccgctgcggatgagcaacatcctcgacatggacgaccggcccgacttcacacaaatcctcacatggaacgacgggcccgaaagccactacatcggcaacatttggcctgagcaagacaacactaccgaaatgcggcggtacgccaacgacgacgcgccccacaaagccatccagcccatcctcagctccttcatcaccgccttcaaatccggcgcctcttcgcaggaaatggcgccgcccggcaacgccagggccgccggctcgctatggttcaagcctatcctcgccaacacatcctgcccgcaggacaacgacctgcacagcggcaagcccgacggctacgaggttgccgtcgacgtctcttcctgggccgtcgtcgtcagcgataatggcgggaacatgacgctgcacggattcagcgacggtgaggagatcggatccgcagacctcgtcgctggattgaactttgggaactttagcgctatgcgggagggtccacagtgcatggaggtgcggagcgagcacggtggattggttgcggtggcaaagggcgggaggaatgtgacgtcggactgccccgacgggatttacaacctgaatccgcagatcctgcagctggtcagtgatgattcggtgggcgggtgcgcgagctcgaagagctcttcgtcagatgatgatgatgatgactcgggaagtgtgctggccgttatgctggacagatacgtcttctggactgcgcttcttgcatccttggcctctgttacaggtgtcgttggactctga

SEQ ID NO: 237 - protein, 500 aa, M. phaseolina
MRLSRRLAAATAGLLYADIVAAVASKAVFAHYMVGTVFEDHVKQDVDDAAAMGLDGFALNVGDPTGSETRTLLGNIMDYAASSHSDFKFFISMDLFSPKNLSDFDQILTDFLGHEAYYKGSDGYPFVSTYGSGEFDENVWSDWRDKWADKIYFVPDFADAMALEGSDGWWDKWGALIAGLFSWESTWPARGQAATFQAVEVDKKPEWTKQRNKAYMIGLSMLQYKNSYGANIYRAGEENLPLRMSNILDMDDRPDFTQILTWNDGPESHYIGNIWPEQDNTTEMRRYANDDAPHKAIQPILSSFITAFKSGASSQEMAPPGNARAAGSLWFKPILANTSCPQDNDLHSGKPDGYEVAVDVSSWAVVVSDNGGNMTLHGFSDGEEIGSADLVAGLNFGNFSAMREGPQCMEVRSEHGGLVAVAKGGRNVTSDCPDGIYNLNPQILQLVSDDSVGGCASSKSSSSDDDDDDSGSVLAVMLDRYVFWTALLASLASVTGVVGL

SEQ ID NO: 238 - DNA, 1110 bp, M. phaseolina
ccggccacctctcctgattcagagaccaattccatacttaccatctgggttgcaggcttgagtatgctacaatacaagaattcctacggcgcgaacatctaccgcgccggcgaagagaacctcccgctgcggatgagcaacatcctcgacatggacgaccggcccgacttcacacaaatcctcacatgggtacgtcacatccccaactgcctctcagccaaatccactgactttttcccccagaacgacgggcccgaaagccactacatcggcaacatttggcctgagcaagacaacactaccgaaatgcggcggtacgccaacgacgacgcgccccacaaagccatccagcccatcctcagctccttcatcaccgccttcaaatccggcgcctcttcgcaggaaatggcgccgcccggcaacgccagggccgccggctcgctatggttcaagcctatcctcgccaacacatcctgcccgcaggacaacgacctgcacagcggcaagcccgacggctacgaggttgccgtcgacgtctcttcctgggccgtcgtcgtcagcgataatggcgggaacatgacgctgcacggattcagcgacggtgaggagatcggatccgcagacctcgtcgctggattgaactttgggaactttagcgctatgcgggagggtccacagtgcatggaggtgcggagcgagcacggtggattggttgcggtggcaaagggcgggaggaatgtgacgtcggactgccccgacgggatttacaacctgaatccgcagatcctgcagctggtcagtgatgattcggtgggcgggtgcgcgagctcgaagagctcttcgtcagatgatgatgatgatgactcgggaagtgtgctggccgttatgctggacagatacgtcttctggactgcgcttcttgcatccttggcctctgttacaggtgtcgttggactctgaggaaaatgaaggaatgaaatgtattaatacggcgtttttgacacaccctgaggaatagagggattagagacacatcgtggactcgttctcgcggcatgccacatggaaaacagcaccatcatgatattttagtatttctctttcacgtca

SEQ ID NO: 239 - DNA, 810 bp, M. phaseolina
atggacgaccggcccgacttcacacaaatcctcacatgggtacgtcacatccccaactgcctctcagccaaatccactgactttttcccccagaacgacgggcccgaaagccactacatcggcaacatttggcctgagcaagacaacactaccgaaatgcggcggtacgccaacgacgacgcgccccacaaagccatccagcccatcctcagctccttcatcaccgccttcaaatccggcgcctcttcgcaggaaatggcgccgcccggcaacgccagggccgccggctcgctatggttcaagcctatcctcgccaacacatcctgcccgcaggacaacgacctgcacagcggcaagcccgacggctacgaggttgccgtcgacgtctcttcctgggccgtcgtcgtcagcgataatggcgggaacatgacgctgcacggattcagcgacggtgaggagatcggatccgcagacctcgtcgctggattgaactttgggaactttagcgctatgcgggagggtccacagtgcatggaggtgcggagcgagcacggtggattggttgcggtggcaaagggcgggaggaatgtgacgtcggactgccccgacgggatttacaacctgaatccgcagatcctgcagctggtcagtgatgattcggtgggcgggtgcgcgagctcgaagagctcttcgtcagatgatgatgatgatgactcgggaagtgtgctggccgttatgctggacagatacgtcttctggactgcgcttcttgcatccttggcctctgttacaggtgtcgttggactctga

SEQ ID NO: 240 - protein, 269 aa, M. phaseolina
MDDRPDFTQILTWVRHIPNCLSAKSTDFFPQNDGPESHYIGNIWPEQDNTTEMRRYANDDAPHKAIQPILSSFITAFKSGASSQEMAPPGNARAAGSLWFKPILANTSCPQDNDLHSGKPDGYEVAVDVSSWAVVVSDNGGNMTLHGFSDGEEIGSADLVAGLNFGNFSAMREGPQCMEVRSEHGGLVAVAKGGRNVTSDCPDGIYNLNPQILQLVSDDSVGGCASSKSSSSDDDDDDSGSVLAVMLDRYVFWTALLASLASVTGVVGL

SEQ ID NO: 241 - DNA, 1083 bp, M. phaseolina
ctttgagaggcacaaatctcggaagctggtagagttctcaggttacagctccttcaataatgtttccgctcgaagtgatgagtgtatatatattctccatacgctcgctttcttgtccaaagcatcacttcctccacctccatctttgcgatgcatcctttgtccttccactccttattaccattcgcgatcagtctggttgccttcttctctcggaatgccagcgctaaggctgtctttgcccactacatggtatgctatcgaccagccttaaccttgctatacaagtctcgttcttgttgcagagcaaaggatgatcggagacttaccctttcacaggtcgggcatgccgatgaggatcacatacatacagatatcgaggatgccgtgactatgggcctcgatggcttctcgctcaacattggcgacccaagacaatcttttgtccgcgaatctctgaacgccatgttcgactacacccgggacaatcatccgaactttaagctctttatcagcatggatctttgggctgctggcgacaccaaaccaaaacagtcagcgacagactttctcagtctcgtgaaagactacaagggccatggtgcataccaacttgcgggccccgacaaccttccgttcgtcacaacatttgctgatggcggcctcaacaacgtaacatggaacgagtggcgcgacgaactggataacaaaatcttcttcattcctgactttgatggaaccgagggatattacgactctgacccaggatggtgggcccattggcaaaatacagtggatggtcttgctagctgggaatctgcttggccgtttcgcgctggatatggtggcgaataccccggtgacgtcagtcccgatgagacggtcttgcagggcgcgacaaatcactcgaagccatatatgattcgtatgtaacaactccttgacgagtgatattaggaactaacaggcatcaaacagctttaagccctttacagtataagaatgcggtaagctctattaccgctcaaccaggtatattatgctaaccatcgcagtatcacacgaacatataccgagccggtg

SEQ ID NO: 242 - DNA, 783 bp, M. phaseolina
atgcatcctttgtccttccactccttattaccattcgcgatcagtctggttgccttcttctctcggaatgccagcgctaaggctgtctttgcccactacatggtatgctatcgaccagccttaaccttgctatacaagtctcgttcttgttgcagagcaaaggatgatcggagacttaccctttcacaggtcgggcatgccgatgaggatcacatacatacagatatcgaggatgccgtgactatgggcctcgatggcttctcgctcaacattggcgacccaagacaatcttttgtccgcgaatctctgaacgccatgttcgactacacccgggacaatcatccgaactttaagctctttatcagcatggatctttgggctgctggcgacaccaaaccaaaacagtcagcgacagactttctcagtctcgtgaaagactacaagggccatggtgcataccaacttgcgggccccgacaaccttccgttcgtcacaacatttgctgatggcggcctcaacaacgtaacatggaacgagtggcgcgacgaactggataacaaaatcttcttcattcctgactttgatggaaccgagggatattacgactctgacccaggatggtgggcccattggcaaaatacagtggatggtcttgctagctgggaatctgcttggccgtttcgcgctggatatggtggcgaataccccggtgacgtcagtcccgatgagacggtcttgcagggcgcgacaaatcactcgaagccatatatgattcgtatgtaa

SEQ ID NO: 243 - protein, 260 aa, M. phaseolina
MHPLSFHSLLPFAISLVAFFSRNASAKAVFAHYMVCYRPALTLLYKSRSCCRAKDDRRLTLSQVGHADEDHIHTDIEDAVTMGLDGFSLNIGDPRQSFVRESLNAMFDYTRDNHPNFKLFISMDLWAAGDTKPKQSATDFLSLVKDYKGHGAYQLAGPDNLPFVTTFADGGLNNVTWNEWRDELDNKIFFIPDFDGTEGYYDSDPGWWAHWQNTVDGLASWESAWPFRAGYGGEYPGDVSPDETVLQGATNHSKPYMIRM

SEQ ID NO: 244 - DNA, 1551 bp, M. phaseolina
gagcaagtgttctcccagaagttagtattcgcacactacatggttcgtcctcaccgatgcatggcgtgatacccgctgctcacgctcaaggattaggtcggaacagtcacggcagaccatgcccaccaagacatcgacaacgccgcagcaatgggcctcgacggcttcgcgctcaacatcggcgacccgacccagccctttgtccggcggacgctggactccatgttcaactacacgcgcgaccggcaccccaaattcaagcacttcttcagcctcgacctctgggcggcgggcggcgcgggaaagaggctcgaggactacgacggcttgctgcgcgacttcatgggccacgcggcgtaccagaaaggggccaacggcttccccttcgtcagcacctttggcgacggcggcaccaccaaggacgtctggctcgcctggcgcgagaagtgggccaacaaggtctacctcgtcccggacttcgaccagacccagggctactacgaggccgcgcccggctggtggagccactggggcgacgtcgtcgacgggctcttcagctgggagtcgacctggccgtgggcgggcgcgcgcagcacggccgacgcctcgctcgaccaggccgtcgcggcgggcgcgcggcagcgcaagaaggcgtacatgatggggctcagcctgctgcagtacaagaacgcgtacggggcgcgggtctggcgcgcgggcgaggacctgctcccgcagcgcatgacgagcatcctggccatgtcgccgccgcccgactacgtcgagctcctgacgtggaacgacgggcccgagagccactacgtcggcagcctgtggccggagcagaacggcgaccgcgagcccgccgcctacgccaacggcgccgcgccccacaccgccctgcagccgctgctggcctccttcatcgccgcgtacaaggccggccgcgggcccgccgccatgcgcccgccccagctgacccccgcccgccccgtcgtcggcgccatctggtacaagcccgtcagctcgcagacgctgtgccccggcgcgggtccgtccgcgcaggagccgctgggctatggcgcggcgagggacgttgtcgcgtacggcgtcgtcgtcggggctggcagcgatgtcgccggctggaagctcaggatgtggagcgggggcgtgcaggtcggggccgcggtgccgctcgtgccgggcctgaacagcggcgtcttcggtgcgctgaatccgggcggccagaggctggaggtgctgaataaggagaacagggttgtcatgagggctgctggcggcaggtgcgtgacaaagacttgtccggacggcatctacaacctgaatcctcaggtcgtggggctgcagatgggcgcggattatcctgcatgtcggccatgaatggggtggggtgggtgcatgaggatcagtaactgagcttcgtgaggcagtgtggcaggtagatggccttgatctgactctcacgacctgttatggaagagtgccgattggccagggggcggaagcgaaagtttttcctgccatttcaac

SEQ ID NO: 245 - DNA, 1251 bp, M. phaseolina
atgggcctcgacggcttcgcgctcaacatcggcgacccgacccagccctttgtccggcggacgctggactccatgttcaactacacgcgcgaccggcaccccaaattcaagcacttcttcagcctcgacctctgggcggcgggcggcgcgggaaagaggctcgaggactacgacggcttgctgcgcgacttcatgggccacgcggcgtaccagaaaggggccaacggcttccccttcgtcagcacctttggcgacggcggcaccaccaaggacgtctggctcgcctggcgcgagaagtgggccaacaaggtctacctcgtcccggacttcgaccagacccagggctactacgaggccgcgcccggctggtggagccactggggcgacgtcgtcgacgggctcttcagctgggagtcgacctggccgtgggcgggcgcgcgcagcacggccgacgcctcgctcgaccaggccgtcgcggcgggcgcgcggcagcgcaagaaggcgtacatgatggggctcagcctgctgcagtacaagaacgcgtacggggcgcgggtctggcgcgcgggcgaggacctgctcccgcagcgcatgacgagcatcctggccatgtcgccgccgcccgactacgtcgagctcctgacgtggaacgacgggcccgagagccactacgtcggcagcctgtggccggagcagaacggcgaccgcgagcccgccgcctacgccaacggcgccgcgccccacaccgccctgcagccgctgctggcctccttcatcgccgcgtacaaggccggccgcgggcccgccgccatgcgcccgccccagctgacccccgcccgccccgtcgtcggcgccatctggtacaagcccgtcagctcgcagacgctgtgccccggcgcgggtccgtccgcgcaggagccgctgggctatggcgcggcgagggacgttgtcgcgtacggcgtcgtcgtcggggctggcagcgatgtcgccggctggaagctcaggatgtggagcgggggcgtgcaggtcggggccgcggtgccgctcgtgccgggcctgaacagcggcgtcttcggtgcgctgaatccgggcggccagaggctggaggtgctgaataaggagaacagggttgtcatgagggctgctggcggcaggtgcgtgacaaagacttgtccggacggcatctacaacctgaatcctcaggtcgtggggctgcagatgggcgcggattatcctgcatgtcggccatga

SEQ ID NO: 246 - protein, 416 aa, M. phaseolina
MGLDGFALNIGDPTQPFVRRTLDSMFNYTRDRHPKFKHFFSLDLWAAGGAGKRLEDYDGLLRDFMGHAAYQKGANGFPFVSTFGDGGTTKDVWLAWREKWANKVYLVPDFDQTQGYYEAAPGWWSHWGDVVDGLFSWESTWPWAGARSTADASLDQAVAAGARQRKKAYMMGLSLLQYKNAYGARVWRAGEDLLPQRMTSILAMSPPPDYVELLTWNDGPESHYVGSLWPEQNGDREPAAYANGAAPHTALQPLLASFIAAYKAGRGPAAMRPPQLTPARPVVGAIWYKPVSSQTLCPGAGPSAQEPLGYGAARDVVAYGVVVGAGSDVAGWKLRMWSGGVQVGAAVPLVPGLNSGVFGALNPGGQRLEVLNKENRVVMRAAGGRCVTKTCPDGIYNLNPQVVGLQMGADYPACRP

SEQ ID NO: 247 - DNA, 2020 bp, M. phaseolina
gcagaacccgccggccatgactccaatacccctcaagtcagtggccatagaggagcgtggtggcaccggaggagctgtataaaaggcgatgctacaccagttaatattgccatcaagcacacaatctctcattcatcactcctcatcatcatggcttccagtcgcggcttcccggccgccttggtcttctttcttgtcctcaccaccgccaatttgggagcagccaaggcattgaccaaaggtgtttttgcccactatatggtaaactgattgcttctttcaactgctgaagccctcactgacgcattcccaggttggaaacgtgtacgaagaccatgctcaccaagacatcaaagatgccttagacatgaatctcgacggattcgccctgaacattggcgacccctcgcaggatttcgtgcgcaagacgttgaactacatgttcgactacgcccgcgacaattaccccgacttcaaactctttattagcatggatctatgggcagcaggctccgcaaagaaaggcttagatgacttcgatagtctcctccgggactacatcggtcatgccgcttactataaaggcccgaatgggtttccatttattagcacctttgccgacggcggtctcgagaacaccacatggatggactggaggaataagtgggcgaacgaaatttacttcatccccgattttgacggttcagcaggctactacaagtctgaccctgcctggtgggagtactggggaggcgtcgtcgatggcatcttcagctgggaatctacttggcctctgcggggcagcaccaagacgtcttattggaaaaatgagacatgggtaagggaaggcgcgttttcgcacgataaggcgtacatgatgggtaagttttctgtccacatagagttttcaccggctaacatttggctacccaggcttgagcatgctgcagtacaagaactcggtgggtcttgcgggctttcgcttcgacctgagcctcaggaactgaccgcgtgcttgatttagtacgagacgaatctttaccgagccggcgaagacaacctgtcctggagaattttcaaccttcagcagatggccccagcgcccgactttattgagatcctgacatgggtgagagctctcgcaaagtaatagttccacgttgacgactgactttattctagaacgacggccccgaaagccattacatcggcaacatctggccggagcagaataatgagaccgatccggccagatacgccacccaggataccttcccccacgacggtatccgtcccttgctgtcctcctttatcagctcttataaggctggaaaggaaatcatggagcctccgactggttacgatgcggttggtgcgctgtggtacaagtccatccactcgagcactgtgtgcccggacaccgacgacctcatcagcaagaaaccggatggctactcggccgcctccgacgtcctcacatgggccgtcatcgtcagctccattggaggaccctataacattcgcggctacagcggcgggcaagaattggagacgttctacctcacggccggctataacttcggcaccttttcctcactgcaagaaggcgaccagcgcatggagctcctcgactccaccggaaaggttattatggcggcatcgggcggccgctgcgttacgtctacctgcccggatggcatctataacctcaacccgcaggttctcgagcttgtcatggacacatcggagaagacgtgcactgagcctattactgaaatgtaccctccgatatctacgaccgcaacctggggaacgagattgtttggtttcaagtatatccttctattcttcgcatcttcgtgattgctgacgtcttgtaaagcggatgtcaaccggggatgaaggcggctatccagcgggcgtacgacgacttccacaggctgaccgaccaaaacggtgtgggtgacaagattgactggaccagcgctgccgcgctcgagctcttggcgcctccctgtat

SEQ ID NO: 248 - DNA, 1350 bp, M. phaseolina
atggcttccagtcgcggcttcccggccgccttggtcttctttcttgtcctcaccaccgccaatttgggagcagccaaggcattgaccaaaggtgtttttgcccactatatggttggaaacgtgtacgaagaccatgctcaccaagacatcaaagatgccttagacatgaatctcgacggattcgccctgaacattggcgacccctcgcaggatttcgtgcgcaagacgttgaactacatgttcgactacgcccgcgacaattaccccgacttcaaactctttattagcatggatctatgggcagcaggctccgcaaagaaaggcttagatgacttcgatagtctcctccgggactacatcggtcatgccgcttactataaaggcccgaatgggtttccatttattagcacctttgccgacggcggtctcgagaacaccacatggatggactggaggaataagtgggcgaacgaaatttacttcatccccgattttgacggttcagcaggctactacaagtctgaccctgcctggtgggagtactggggaggcgtcgtcgatggcatcttcagctgggaatctacttggcctctgcggggcagcaccaagacgtcttattggaaaaatgagacatgggtaagggaaggcgcgttttcgcacgataaggcgtacatgatggccattacatcggcaacatctggccggagcagaataatgagaccgatccggccagatacgccacccaggataccttcccccacgacggtatccgtcccttgctgtcctcctttatcagctcttataaggctggaaaggaaatcatggagcctccgactggttacgatgcggttggtgcgctgtggtacaagtccatccactcgagcactgtgtgcccggacaccgacgacctcatcagcaagaaaccggatggctactcggccgcctccgacgtcctcacatgggccgtcatcgtcagctccattggaggaccctataacattcgcggctacagcggcgggcaagaattggagacgttctacctcacggccggctataacttcggcaccttttcctcactgcaagaaggcgaccagcgcatggagctcctcgactccaccggaaaggttattatggcggcatcgggcggccgctgcgttacgtctacctgcccggatggcatctataacctcaacccgcaggttctcgagcttgtcatggacacatcggagaagacgtgcactgagcctattactgaaatgtaccctccgatatctacgaccgcaacctggggaacgagattgtttggtttcaagtatatccttctattcttcgcatcttcgtgattgctga

SEQ ID NO: 249 - protein, 449 aa, M. phaseolina
MASSRGFPAALVFFLVLTTANLGAAKALTKGVFAHYMVGNVYEDHAHQDIKDALDMNLDGFALNIGDPSQDFVRKTLNYMFDYARDNYPDFKLFISMDLWAAGSAKKGLDDFDSLLRDYIGHAAYYKGPNGFPFISTFADGGLENTTWMDWRNKWANEIYFIPDFDGSAGYYKSDPAWWEYWGGVVDGIFSWESTWPLRGSTKTSYWKNETWVREGAFSHDKAYMMAITSATSGRSRIMRPIRPDTPPRIPSPTTVSVPCCPPLSALIRLERKSWSLRLVTMRLVRCGTSPSTRALCARTPTTSSARNRMATRPPPTSSHGPSSSAPLEDPITFAATAAGKNWRRSTSRPAITSAPFPHCKKATSAWSSSTPPERLLWRHRAAAALRLPARMASITSTRRFSSLSWTHRRRRALSLLLKCTLRYLRPQPGERDCLVSSISFYSSHLRDC

SEQ ID NO: 250 - DNA, 1945 bp, M. phaseolina
tggacgcccgtcattccaccttgatcctgctccctcccgggcaatataaatccgacctagcaagctgaacctcatctgctcctttgcaacccacatctgcttcgccgacaccacttccatatcctttctacgctgccgaactctgccagtatggagtttgcccttgtctttgcgctggtccttggcgccctcagccagtccgtttctactgccctggtcatttccagcttcgaggtaattgcttctagacagacttgcagactctgcttaccttgccacagcttatattcgccgaaacctacactgtcgacacctggaagactgacattgcctcagctaaagcagcaggaattgatggcttcggtgcgtctcgaccatttcgtctcggctcccgaactgtcacactgacatttgaatccgtagctctggtcgcggttcctcccaactgtcaatcccaagacttgagctggcagactgccaggatcaaggatgcatacactgctgcagatattgagaacttttcgatcgttccggcctttgacatgagttatagtttccgtacagagaattgtccaaccggtatcgcctggaacatgacgtacatgtcgaccatcatctcggatgccagcaaacaggccgcgacctaccgctggaaagatactgtgctgatcatcaccggggacagtggcctctatgccgacgactacttctcccagatgaaatctctcctcaatcgtcagggggttaatatcagcgtcgctccgtacatcgagaagtatgtggaagcagctactcgctacggtgaacccgataaggacgcgaaatttgccttcttggactatccttctatcgatggcttttacaacggttagtagagaactcctagagtctaacggtgcaaaactaattgataaacaaagaattggcctggccgatgaatgtccgccaaaacctgacctgcgacgttgataacgctttcaaggctgccatggaaaaggcgggaaggaccggcccgtacataatggccgtctcaccgtggtactacgagaatcgcaacaccaacaatcctgccgacagccgcgtccagtacagtgacaccctttggtactaccgctggagtggtgtcatcaacgatacgaagcccgacattgtgaatatcgtaagctggaacagctggaatacctcatcttaccttcgcgatgtaccccaggagaatggcacttcccctggttgcgtcagcctcggcgagcaaggcaactacgtctacggcatgaaccactcggcttggcgggacatgagtgctcattatgccaactactacaagaccgggactgaacctgagctcaaggacaacaaactgatctactggtaccgcgtacaccgtaagaatgcgaagtgcagtggtggccaaagttccgcgacaggcacagtccagaactccgatttccctgatgactcggtcttcatctgggccgctgtgcgtgccgaggtcgagatcgaagtcttttacggcaatgctcccgactcgcaagacatgaggcctggctctcccaaggtgaccttcacgacggccaaccagactggaccccaactctttgagctgccgttccctcaagatttcccgttgaatagcagcgatatcctctacccgcacgtcctggtctatccgaccaacatccgccgcattgcgtactcgaagtacaacagcgtgccgatcacggcggagtgctcttgggagaatttcaatccggtggtccagagcttgggggatgatttcaacgagatcatggggtaacttcggggagcatcagcgtgggacacgcgaagatgccaggagagcttgagaagacggcatgactgaacgacgagaacgagcataaccgcaatgcaccttgctatcgaagaacaatgatttccattccctgatgctgccgtgtacaacttc

SEQ ID NO: 251 - DNA, 1485 bp, M. phaseolina
atggagtttgcccttgtctttgcgctggtccttggcgccctcagccagtccgtttctactgccctggtcatttccagcttcgagcttatattcgccgaaacctacactgtcgacacctggaagactgacattgcctcagctaaagcagcaggaattgatggcttcgctctggtcgcggttcctcccaactgtcaatcccaagacttgagctggcagactgccaggatcaaggatgcatacactgctgcagatattgagaacttttcgatcgttccggcctttgacatgagttatagtttccgtacagagaattgtccaaccggtatcgcctggaacatgacgtacatgtcgaccatcatctcggatgccagcaaacaggccgcgacctaccgctggaaagatactgtgctgatcatcaccggggacagtggcctctatgccgacgactacttctcccagatgaaatctctcctcaatcgtcagggggttaatatcagcgtcgctccgtacatcgagaagtatgtggaagcagctactcgctacggtgaacccgataaggacgcgaaatttgccttcttggactatccttctatcgatggcttttacaacgaattggcctggccgatgaatgtccgccaaaacctgacctgcgacgttgataacgctttcaaggctgccatggaaaaggcgggaaggaccggcccgtacataatggccgtctcaccgtggtactacgagaatcgcaacaccaacaatcctgccgacagccgcgtccagtacagtgacaccctttggtactaccgctggagtggtgtcatcaacgatacgaagcccgacattgtgaatatcgtaagctggaacagctggaatacctcatcttaccttcgcgatgtaccccaggagaatggcacttcccctggttgcgtcagcctcggcgagcaaggcaactacgtctacggcatgaaccactcggcttggcgggacatgagtgctcattatgccaactactacaagaccgggactgaacctgagctcaaggacaacaaactgatctactggtaccgcgtacaccgtaagaatgcgaagtgcagtggtggccaaagttccgcgacaggcacagtccagaactccgatttccctgatgactcggtcttcatctgggccgctgtgcgtgccgaggtcgagatcgaagtcttttacggcaatgctcccgactcgcaagacatgaggcctggctctcccaaggtgaccttcacgacggccaaccagactggaccccaactctttgagctgccgttccctcaagatttcccgttgaatagcagcgatatcctctacccgcacgtcctggtctatccgaccaacatccgccgcattgcgtactcgaagtacaacagcgtgccgatcacggcggagtgctcttgggagaatttcaatccggtggtccagagcttgggggatgatttcaacgagatcatggggtaa

SEQ ID NO: 252 - protein, 494 aa, M. phaseolina
MEFALVFALVLGALSQSVSTALVISSFELIFAETYTVDTWKTDIASAKAAGIDGFALVAVPPNCQSQDLSWQTARIKDAYTAADIENFSIVPAFDMSYSFRTENCPTGIAWNMTYMSTIISDASKQAATYRWKDTVLIITGDSGLYADDYFSQMKSLLNRQGVNISVAPYIEKYVEAATRYGEPDKDAKFAFLDYPSIDGFYNELAWPMNVRQNLTCDVDNAFKAAMEKAGRTGPYIMAVSPWYYENRNTNNPADSRVQYSDTLWYYRWSGVINDTKPDIVNIVSWNSWNTSSYLRDVPQENGTSPGCVSLGEQGNYVYGMNHSAWRDMSAHYANYYKTGTEPELKDNKLIYWYRVHRKNAKCSGGQSSATGTVQNSDFPDDSVFIWAAVRAEVEIEVFYGNAPDSQDMRPGSPKVTFTTANQTGPQLFELPFPQDFPLNSSDILYPHVLVYPTNIRRIAYSKYNSVPITAECSWENFNPVVQSLGDDFNEIMG

SEQ ID NO: 253 - DNA, 2805 bp, M. phaseolina
cagcgtcactagctcgagatatgtcggtagcaggtgagggttacagtcgggtcccagagtgggatggcatcaacatgtaaaaatgtcaccctcgtgctctgcttctgccagcccagcgcctctcctgctgccctgcgcctcagctcggccatgatctccctgacattcgatgccgtgtgcctcctggctgccgccgctggctgccttgccgctccgtcccgacgcgactggctcggtgccgcttccagtgatgtgagaccaacaccactgagctgattgcgacgctggctgacgtggattaggtcgtgaccgtgtctctgctccaatccctcaacaacagagccttcggccacttccccggggatgccgacttcgacggctccgcgcagtcttatccggcctccgagctgcagtactcgggttccttcacttcgaccgcaacgggggtcgaatatctctttcccgcctcccaagcttcgaacgccagcgacaacgtgctgtgccttggtcagaccatctcggtcccggcagcatcttatctgagcgcccagctcctggtggctagcgacaagagggacaccatcgtgtccgacaacatcaccttcacctacgccgacaacacctcctccgtggcggagatccgtgccgagccatggtgggccttcttgactatgtacaagggcgaagtgattttgccgtaccgctaccttgccaatgataccaacttcaacaccacccatgtttacgagtggtctggcgctttggatccctcaaagcagctggcctccatcactctgccatccaccagcaataccactactgggcgtatgcacgtcttcgctttgtccctgcgcagcccctccgggcttcgcgcccaacacattcgccccacccagaagcaggaggagggcaatgtgcagatcgttgaggtgactgtcggcaattctggcccaggctgggtccatggtggcggagtgtgggtcactgtcgaggctcctggcgttaggacggtcaggccagctcagatcaaacgcctgcgcgccggcgaccagaagaaggtgaacgtgggcgtcgtggggtcctcgcgctccactgccaccgtcagactgtcaaatggaaacgagaccaccagtttcacctttcccgatgtcgacttcggcctgaagaattacaccgagtcgctggacagcctgacgctgcatgaatctcccgactggttcaacaacgccaagtttggtatttttatccactggggcccttatgccgtgcctggttgggggaactcaaccccctacgaagtatatgcggagtggtactggtggtactcccatcacctcgccgctgacaaggccgacacctacgactatcacctgcgcacctttggccccgacgtcaactacgacgacttcttcgtcaatttcactgctgcaaacttcgatcctaaggcttgggtcgatctgtttgatgatgccggtgcccagtatttcgtactgaccaccaaggtttgttttgagcggtcctagtcaccgtttccctgcaggctgacgctcttcagcatcatgatggctttgcgctgttcgacccgaaggagacgtccaacagaagcgcgctaaactacgggcccaagcgagatctcctgaaggaactgtttgacgcagcaaaaacctaccagccccacctgcaccgcggcacctatttctccttgcccgaatggtataacccagatttcgggtacgggccctcggcgctcttccgcttgaagacgtatactgaccgctgtgcagaccctacggcttcgcgcaaaacgaaggaaacgcgtcgacatcatggcccggcatcttggcgacgaaccagtacactggcgaaacggaaccctacactggacacgttcccgtcgccgacttcatcgctgatctcatggtcccgcagcaggagatcttggcctacgactacgaaacggacatcatgtggtgcgactgtggtgccgccaatggctcggctgccttcgcatccgagtggttcaaccgcgccgccgctgccggaaggcaggtcacgatgaacagccgctgtggcatcgcccagggcagcgacttcgacacgcccgagtacaccaccttcagtagcgtgtcgccccgcaagtgggagagcaatcagggtatggatccctacagctacggctacaaccgcgccacggccgacagcgcgtacatgaacgcgtccacggtcgtcgcttccctcgtcgacatggtctcaaagaacggcaacttcctgctcgatatcggtccgagggccgacggctccatcgtcgaggtcgaggcacagaacctgcgcgaggccggcaagtggatcaagaagcatggcgaggccgtcttcaacacgacttactggtttgtcatgcccgagctggacagcatcaggttcacccagaccaacgacgccttctacctcctgttcttggaggagccggtcgctggccaggacgtgctggtcgaggcgccgctgccagttttgcctggagacaaggtcacggtgcttggtgaagggctggatgtcgaatggaagacggtaggtagtggtgtgagcttgacatggcctgcgaaaatggaaggtaaaggtgagtattgctgggtggtgaagattgagtatgctgcatgacttttcttgtaagctgtacgatgactcaatactttacactcaaacgtttgatcctcactcaaatggaaagattgtcctgcgctttcgcgagccattgtaatatctatagcctggttggtaatatcggctcgaccctttcaatctgccggc

SEQ ID NO: 254 - DNA, 2349 bp, M. phaseolina
atgatctccctgacattcgatgccgtgtgcctcctggctgccgccgctggctgccttgccgctccgtcccgacgcgactggctcggtgccgcttccagtgatgtcgtgaccgtgtctctgctccaatccctcaacaacagagccttcggccacttccccggggatgccgacttcgacggctccgcgcagtcttatccggcctccgagctgcagtactcgggttccttcacttcgaccgcaacgggggtcgaatatctctttcccgcctcccaagcttcgaacgccagcgacaacgtgctgtgccttggtcagaccatctcggtcccggcagcatcttatctgagcgcccagctcctggtggctagcgacaagagggacaccatcgtgtccgacaacatcaccttcacctacgccgacaacacctcctccgtggcggagatccgtgccgagccatggtgggccttcttgactatgtacaagggcgaagtgattttgccgtaccgctaccttgccaatgataccaacttcaacaccacccatgtttacgagtggtctggcgctttggatccctcaaagcagctggcctccatcactctgccatccaccagcaataccactactgggcgtatgcacgtcttcgctttgtccctgcgcagcccctccgggcttcgcgcccaacacattcgccccacccagaagcaggaggagggcaatgtgcagatcgttgaggtgactgtcggcaattctggcccaggctgggtccatggtggcggagtgtgggtcactgtcgaggctcctggcgttaggacggtcaggccagctcagatcaaacgcctgcgcgccggcgaccagaagaaggtgaacgtgggcgtcgtggggtcctcgcgctccactgccaccgtcagactgtcaaatggaaacgagaccaccagtttcacctttcccgatgtcgacttcggcctgaagaattacaccgagtcgctggacagcctgacgctgcatgaatctcccgactggttcaacaacgccaagtttggtatttttatccactggggcccttatgccgtgcctggttgggggaactcaaccccctacgaagtatatgcggagtggtactggtggtactcccatcacctcgccgctgacaaggccgacacctacgactatcacctgcgcacctttggccccgacgtcaactacgacgacttcttcgtcaatttcactgctgcaaacttcgatcctaaggcttgggtcgatctgtttgatgatgccggtgcccagtatttcgtactgaccaccaagcatcatgatggctttgcgctgttcgacccgaaggagacgtccaacagaagcgcgctaaactacgggcccaagcgagatctcctgaaggaactgtttgacgcagcaaaaacctaccagccccacctgcaccgcggcacctatttctccttgcccgaatggtataacccagatttcggaccctacggcttcgcgcaaaacgaaggaaacgcgtcgacatcatggcccggcatcttggcgacgaaccagtacactggcgaaacggaaccctacactggacacgttcccgtcgccgacttcatcgctgatctcatggtcccgcagcaggagatcttggcctacgactacgaaacggacatcatgtggtgcgactgtggtgccgccaatggctcggctgccttcgcatccgagtggttcaaccgcgccgccgctgccggaaggcaggtcacgatgaacagccgctgtggcatcgcccagggcagcgacttcgacacgcccgagtacaccaccttcagtagcgtgtcgccccgcaagtgggagagcaatcagggtatggatccctacagctacggctacaaccgcgccacggccgacagcgcgtacatgaacgcgtccacggtcgtcgcttccctcgtcgacatggtctcaaagaacggcaacttcctgctcgatatcggtccgagggccgacggctccatcgtcgaggtcgaggcacagaacctgcgcgaggccggcaagtggatcaagaagcatggcgaggccgtcttcaacacgacttactggtttgtcatgcccgagctggacagcatcaggttcacccagaccaacgacgccttctacctcctgttcttggaggagccggtcgctggccaggacgtgctggtcgaggcgccgctgccagttttgcctggagacaaggtcacggtgcttggtgaagggctggatgtcgaatggaagacggtaggtagtggtgtgagcttgacatggcctgcgaaaatggaaggtaaaggtgagtattgctgggtggtgaagattgagtatgctgcatga

SEQ ID NO: 255 - protein, 782 aa, M. phaseolina
MISLTFDAVCLLAAAAGCLAAPSRRDWLGAASSDVVTVSLLQSLNNRAFGHFPGDADFDGSAQSYPASELQYSGSFTSTATGVEYLFPASQASNASDNVLCLGQTISVPAASYLSAQLLVASDKRDTIVSDNITFTYADNTSSVAEIRAEPWWAFLTMYKGEVILPYRYLANDTNFNTTHVYEWSGALDPSKQLASITLPSTSNTTTGRMHVFALSLRSPSGLRAQHIRPTQKQEEGNVQIVEVTVGNSGPGWVHGGGVWVTVEAPGVRTVRPAQIKRLRAGDQKKVNVGVVGSSRSTATVRLSNGNETTSFTFPDVDFGLKNYTESLDSLTLHESPDWFNNAKFGIFIHWGPYAVPGWGNSTPYEVYAEWYWWYSHHLAADKADTYDYHLRTFGPDVNYDDFFVNFTAANFDPKAWVDLFDDAGAQYFVLTTKHHDGFALFDPKETSNRSALNYGPKRDLLKELFDAAKTYQPHLHRGTYFSLPEWYNPDFGPYGFAQNEGNASTSWPGILATNQYTGETEPYTGHVPVADFIADLMVPQQEILAYDYETDIMWCDCGAANGSAAFASEWFNRAAAAGRQVTMNSRCGIAQGSDFDTPEYTTFSSVSPRKWESNQGMDPYSYGYNRATADSAYMNASTVVASLVDMVSKNGNFLLDIGPRADGSIVEVEAQNLREAGKWIKKHGEAVFNTTYWFVMPELDSIRFTQTNDAFYLLFLEEPVAGQDVLVEAPLPVLPGDKVTVLGEGLDVEWKTVGSGVSLTWPAKMEGKGEYCWVVKIEYAA

SEQ ID NO: 256 - DNA, 2600 bp, M. phaseolina
ccttggtgccattgtcttccgcacaggcattattcatgccgcagaatgcctttcaacctctggcaggacaacctctttcattcccagtggacttaagtcctttgttcaacaatcgtggattcgggctgacccccaacgaatccgattttgatggaatgggcggcaagttgccggcttcgcatcactcgaatcgaagactaatgcgctacagctgccttccctgccgagtccataccgccatccagctttgtgtactcgggcttcaactaccaatttccggaatatcgacaaacaggaaatgacaatgtcatcgcaactggacagacgctctcagtgccgcgcggcaaatacatcagcgtcgcattgctcgcagccagcgaaaccggccttgcctcaaccactgtcaatgcttcctacgctgatggaagtgagggttctgacgcaatcctcgtgcctgcttggtggaactggccgtatccggctggtggcgacatcgtcctcccttatcgattgaccaacgagactgtcgactataatcgaaccaacatcttccacgtcacaggctggctggattcgagcaaagatcttacttctctgactctgccaaacgtcaccggaggttccagcacctctccaggcggtgctgctgttgaagcaaggctgcacatattcgccttgtcactcctaccagtggcaaacactcctcccccgggcccccagctggaggttcagtatgcgaggtcaacccagaaatggattgaaggaacgaacaagactcagatcttcgaggtcaccatcaacaacgtgggcacggacttcgtactgaaagaccattcagtctccgtctgggtagagtccgccggcgtggaaacggtaacaaatgctaccgtcaaacgcttaaggcatggagatcaggccgtggtggaggtaggcgtcgtcaacaaaggcggagttgagccagggaccgtcgggaacgcaactgtacatgttgccggagaaggcatgccgagcaccgagtacaccctgaatgcaacgttcggcgttgcagactatcaagccacctacgattcggtatactcccatgaatctcccagctggtttaacgatgcaaaatatgggatttttatccactggggcgtctatgctgtgcctggatggggtaattccggcgagaacgaaagctatgctgaatggtactggtggcatcagaacgagggaccgggaacgtctgtcggaacctgggaataccaccttgaaaattatggccccgacgtagtctacgatgacttcatccaaaacttcactgccagtgctttcgatcctaagagctgggtagacctcttcgccgatgcgggtgcccaatacttcgtccaagtctccaagcaccacgacggtatgtgtggacagtgcccacctcacttcacccactaaacaccacaggctacgctatcttcgacctccccgccaacgtctcgcaacgtacctccgtcgccctgccgccccaccgcaacctcctccaagagctcttcgacgccgcctcaacccaccaaccacagctccaccgcgccgtctacttctccctccccgaatggttccaccccgactatgcgcgctatggcttcggcgactggcccggtggcaatgccacgaatccctacacaaacgaatccctcccctacgcgggctacgtgcccgtcggtgactacatcaccgacgtcatcgttcccgaaatggacgcactcgccgacatgggcatcgagatcatgtggtgcgacatcggcgggcccaacgtcaccgccgagtgggcgtcgagctggttcaaccgcgcggccgccgaagggcgccaggtcgtcatgaatgcgcgctgcggactccctggcgatttcgacacgcccgagtatgcgcgctatgcgggcgtgcaggcgcgcaagtgggagagcaatctcggcatggatccgtactcgtatgggtataatcgcgcgacgccggatgaggcgtacatgaatgcgtcggcgattgtgaggagcttggtcgatattgtgagcaagaacgggaacttcctgttggatgtcgggcccatggaaaacggcacgatcgtggagatttgtcagagcaatttgagggaggccggtgagtggattaaaggacatgcagaggcggtgtttgggacgaggtattggagcgttacgccgcaggaaggggagagtgtaaggttcacgactacagcggatgcattttatatgctgttgttggagaagccggatggagagctcgtgctggagagcccggtgccgtgggtcgagggggatgaggttactgttgttggtgggagtttgaacgggactgtggttccaagccggcagcaagatgatggaagagtagttttggaaatctcagatgaggttgctaatggtgatcagtttgtgtgggtatttaagatcacctactgaagggaagggctcggtactactcaggcatctgaatcctgcgtccatgcaaaggcagccagggccgttctctggcatatatctgtatatgatccttcataacgagatctcgtctccacaaatacgtcagaagcgttcaacgaccagtcgagg

SEQ ID NO: 257 - DNA, 2208 bp, M. phaseolina
atggaatgggcggcaactgccttccctgccgagtccataccgccatccagctttgtgtactcgggcttcaactaccaatttccggaatatcgacaaacaggaaatgacaatgtcatcgcaactggacagacgctctcagtgccgcgcggcaaatacatcagcgtcgcattgctcgcagccagcgaaaccggccttgcctcaaccactgtcaatgcttcctacgctgatggaagtgagggttctgacgcaatcctcgtgcctgcttggtggaactggccgtatccggctggtggcgacatcgtcctcccttatcgattgaccaacgagactgtcgactataatcgaaccaacatcttccacgtcacaggctggctggattcgagcaaagatcttacttctctgactctgccaaacgtcaccggaggttccagcacctctccaggcggtgctgctgttgaagcaaggctgcacatattcgccttgtcactcctaccagtggcaaacactcctcccccgggcccccagctggaggttcagtatgcgaggtcaacccagaaatggattgaaggaacgaacaagactcagatcttcgaggtcaccatcaacaacgtgggcacggacttcgtactgaaagaccattcagtctccgtctgggtagagtccgccggcgtggaaacggtaacaaatgctaccgtcaaacgcttaaggcatggagatcaggccgtggtggaggtaggcgtcgtcaacaaaggcggagttgagccagggaccgtcgggaacgcaactgtacatgttgccggagaaggcatgccgagcaccgagtacaccctgaatgcaacgttcggcgttgcagactatcaagccacctacgattcggtatactcccatgaatctcccagctggtttaacgatgcaaaatatgggatttttatccactggggcgtctatgctgtgcctggatggggtaattccggcgagaacgaaagctatgctgaatggtactggtggcatcagaacgagggaccgggaacgtctgtcggaacctgggaataccaccttgaaaattatggccccgacgtagtctacgatgacttcatccaaaacttcactgccagtgctttcgatcctaagagctgggtagacctcttcgccgatgcgggtgcccaatacttcgtccaagtctccaagcaccacgacggctacgctatcttcgacctccccgccaacgtctcgcaacgtacctccgtcgccctgccgccccaccgcaacctcctccaagagctcttcgacgccgcctcaacccaccaaccacagctccaccgcgccgtctacttctccctccccgaatggttccaccccgactatgcgcgctatggcttcggcgactggcccggtggcaatgccacgaatccctacacaaacgaatccctcccctacgcgggctacgtgcccgtcggtgactacatcaccgacgtcatcgttcccgaaatggacgcactcgccgacatgggcatcgagatcatgtggtgcgacatcggcgggcccaacgtcaccgccgagtgggcgtcgagctggttcaaccgcgcggccgccgaagggcgccaggtcgtcatgaatgcgcgctgcggactccctggcgatttcgacacgcccgagtatgcgcgctatgcgggcgtgcaggcgcgcaagtgggagagcaatctcggcatggatccgtactcgtatgggtataatcgcgcgacgccggatgaggcgtacatgaatgcgtcggcgattgtgaggagcttggtcgatattgtgagcaagaacgggaacttcctgttggatgtcgggcccatggaaaacggcacgatcgtggagatttgtcagagcaatttgagggaggccggtgagtggattaaaggacatgcagaggcggtgtttgggacgaggtattggagcgttacgccgcaggaaggggagagtgtaaggttcacgactacagcggatgcattttatatgctgttgttggagaagccggatggagagctcgtgctggagagcccggtgccgtgggtcgagggggatgaggttactgttgttggtgggagtttgaacgggactgtggttccaagccggcagcaagatgatggaagagtagttttggaaatctcagatgaggttgctaatggtgatcagtttgtgtgggtatttaagatcacctactga

SEQ ID NO: 258 - protein, 735 aa, M. phaseolina
MEWAATAFPAESIPPSSFVYSGFNYQFPEYRQTGNDNVIATGQTLSVPRGKYISVALLAASETGLASTTVNASYADGSEGSDAILVPAWWNWPYPAGGDIVLPYRLTNETVDYNRTNIFHVTGWLDSSKDLTSLTLPNVTGGSSTSPGGAAVEARLHIFALSLLPVANTPPPGPQLEVQYARSTQKWIEGTNKTQIFEVTINNVGTDFVLKDHSVSVWVESAGVETVTNATVKRLRHGDQAVVEVGVVNKGGVEPGTVGNATVHVAGEGMPSTEYTLNATFGVADYQATYDSVYSHESPSWFNDAKYGIFIHWGVYAVPGWGNSGENESYAEWYWWHQNEGPGTSVGTWEYHLENYGPDVVYDDFIQNFTASAFDPKSWVDLFADAGAQYFVQVSKHHDGYAIFDLPANVSQRTSVALPPHRNLLQELFDAASTHQPQLHRAVYFSLPEWFHPDYARYGFGDWPGGNATNPYTNESLPYAGYVPVGDYITDVIVPEMDALADMGIEIMWCDIGGPNVTAEWASSWFNRAAAEGRQVVMNARCGLPGDFDTPEYARYAGVQARKWESNLGMDPYSYGYNRATPDEAYMNASAIVRSLVDIVSKNGNFLLDVGPMENGTIVEICQSNLREAGEWIKGHAEAVFGTRYWSVTPQEGESVRFTTTADAFYMLLLEKPDGELVLESPVPWVEGDEVTVVGGSLNGTVVPSRQQDDGRVVLEISDEVANGDQFVWVFKITY

SEQ ID NO: 259 - DNA, 3395 bp, M. phaseolina
agctaaacacgactgaatactctcttgcttgagcgagtaattttccgcgaaagggttggaccagtttccaaatgttgaggactgtgaatgaagctcctctcttattgcccagggcgtgaactgacgggcttccctcccgtggagctcagcatgaaccgagtaagcatgatagatacgtgggtcgggccatgctcggtcaccgcatctttccgatcgttgcctgacaaggaaactcgctctgtctcggcttgctgcaatctaccagacgtgaaaccaaactggagatgctggaagtcttgaacaacactcggactgcgaggacgtgatctaatgcttggcattggatttcatggcgagatacggccaaggccttcccgatgtaaggccagttttcaattatcccaggtcgttcgcctgctcccatgacaaatgccatgagttggcacgtatgctacggctctgcttggccattgtgctaagaacttgtaccgtaaatcttgtatgtaaatgggaggtaatctcggattcggctcctcttacattctgaagtgggtatagggcggacgcctaacgcccagaacggaaggaattgcctggaagccgcggaacacaacgacccccgctcctcgaagacctcgtaggtgtatgtacatttactgcagcgttgggaatcatcaatcggagtcttagagcggaaatgaattatcaaatggttttgcgactgtcgagcttggctgagtctgcgataatgcactttcaccaccgttgcgcccgcttcatccccggcgaaggatgcttctcagtcagggctgagatcaagagccgccaatattctactctctattgcaaggagctcagtcaagcagtccaccacttggcggaggctgcgaaatgcattcgctctctgcgtcccacatcctcggtttggtgccggtggtggcataagtctagtggtgccaacgcgactccacggtgactcgataggcatatcatcgtcaggcaaagctgctgaggtgttgtcttgggcctcctgagcacttgaggtggtagggtagtagtgtgcggaatatcggtggagtgccaggaggagaaggacagcgtcaatatggcaactccgaccgatgaggcggagatttatgcttcaatgtgtcgcaaaaaaataataaataaaaaaatgcgaggttttttttgactggtgctctctcgcaatggcgtccgttcctttttgggagactcggcgacgttttgcaaggtggacttggtgttattcaggtgaagcgttcataacacgtgcgaggaatagggtacagctgctgcgccgcggtattcacagaagaaatggtgcaggccggcaccagctcgggaaagcggatagtccgggcggcctcaatcagcgtctagtgatgtggaatggtcgggttgtctggcgggacaaagcgcaagtcacatggatttgaagcattcacccgaaggcagatgttagggaactcctgacactcacgtcaccactgatcacccatgcttttaaaacatgctaaaattcgccaaaaattttatagacgcaggttgcatcgtgaaggtgcaagggttccaattgcggggtacgaactccaaaaaaaaaaaaggcacccgccaccatagattcgataatatgctgctcgtgctttcgaatatgaagtcatttaaggttttgcgctgtttaactcgctcttcacgttactggttgaacattcaaggctgacactgccagacagaggctccagatcacagttctgagccaacgcaagcaacatatttgtcgcaagcagtgtgactcttgcgctgctgcttcgagccgcgtccacactgaagactcccagggaaattccatctacgactggaccttcatggaccgcgttttcgattcctacctgtccgctaacgtaaaaccatatgtgcaaattggctttatgcctctggccttatcagcaggtccagatcccaacttcttcacgttcacgccaacctcgtcctatgatgccatctacaccggatggtccagcccacccaccaactatcaaacgtgggaggaattgctatatcaatggacaaagcacaacgtggagaagtacgggcaagccgaagtggagtcgtggtactgggaagtctggaacgagcccaacgtcgcctactggaacggcacgcgcgacgagttctgcgcactgcacgaccacgccatcgccgccgtccgccgcgccctcccaaccgcacgagtcggaggctgcgaagcagccggcggagcggcggagcggctacctcgcagggctcctgagccacagcctgcacggtggcaactgcgccaccggcgagacaggcacgccgcgcttcatcaaagccacggcgcgaaggagggtggcttcgtccggatgaacctctccgcgcagctgcagcagatcgatggggcgttcagcgtcggggcgtccttcgcggagctgcgccagacgcccatcgtgatgggcgagtacgatcccgacgggtgcgcggcgtgccagacgccgcagtacgggtacgagaacggcccgctgtatcagtcctatacgattgcgacgtttgttcgcgccttggatctggcggacagatggggcgtcaatcggcaaggggcgctgacctgggcgtttgagtacgaggaggcggagttgtttaatgatacgacatactttgatggcttccgtgtgctcgcgacgcagggtattgacaagccggtgctcaacgcccatcgaatgttggggatgatgacaagagacagggtctgggctgagagtgacggtcaggtgtcattggatgaagcggtggctgggagcgtcagaggcaagaccgatgtgggtgtactagctagcgccgacgaggagcgggtgtatgttctggtctggtattaccatgacaacgacaccagcttccaagatgcgcaggtagatttgacgatcggagggctggagaacagaacatctgcgaacctgacgcatttccgcctcgacgaggaacacagcaactcttattcactgtggcgggctttacgctccccaacagcccccacaccggtggattatgagcgtctggtagctgcaggtaaacttgagaaactagagacgtcagggaatgtcagcgttgatgaggatggaaagtatatcatgtcatttgccttgccaatacgatctctctcattagttgtggtggagcatgttgaagcaggcaacaagatttcctaatatcgtccaacattggatcacagtgaatggcaaaagaccatccccactttccaatccaattttcatgaaaaaaaaaaataaaaagaacagaataaaacaaataataaaccccattgccatgagctgaatggttcatggagagccgaagca

SEQ ID NO: 260 - DNA, 1491 bp, M. phaseolina
atgaaccgaatcacagttctgagccaacgcaagcaacatatttgtcgcaagcagtgtgactcttgcgctgctgcttcgagccgcgtccacactgaagactcccagggaaattccatctacgactggaccttcatggaccgcgttttcgattcctacctgtccgctaacgtaaaaccatatgtgcaaattggctttatgcctctggccttatcagcaggtccagatcccaacttcttcacgttcacgccaacctcgtcctatgatgccatctacaccggatggtccagcccacccaccaactatcaaacgtgggaggaattgctatatcaatggacaaagcacaacgtggagaagtacgggcaagccgaagtggagtcgtggtactgggaagtctggaacgagcccaacgtcgcctactggaacggcacgcgcgacgagttctgcgcactgcacgaccacgccatcgccgccgtccgccgcgccctcccaaccgcacgagtcggaggctgcgaagcagccggcggagcggcggagcggctacctcgcagggctcctgagccacagcctgcacggtggcaactgcgccaccggcgagacaggcacgccgcgcttcatcaaagccacggcgcgaaggagggtggcttcgtccggatgaacctctccgcgcagctgcagcagatcgatggggcgttcagcgtcggggcgtccttcgcggagctgcgccagacgcccatcgtgatgggcgagtacgatcccgacgggtgcgcggcgtgccagacgccgcagtacgggtacgagaacggcccgctgtatcagtcctatacgattgcgacgtttgttcgcgccttggatctggcggacagatggggcgtcaatcggcaaggggcgctgacctgggcgtttgagtacgaggaggcggagttgtttaatgatacgacatactttgatggcttccgtgtgctcgcgacgcagggtattgacaagccggtgctcaacgcccatcgaatgttggggatgatgacaagagacagggtctgggctgagagtgacggtcaggtgtcattggatgaagcggtggctgggagcgtcagaggcaagaccgatgtgggtgtactagctagcgccgacgaggagcgggtgtatgttctggtctggtattaccatgacaacgacaccagcttccaagatgcgcaggtagatttgacgatcggagggctggagaacagaacatctgcgaacctgacgcatttccgcctcgacgaggaacacagcaactcttattcactgtggcgggctttacgctccccaacagcccccacaccggtggattatgagcgtctggtagctgcaggtaaacttgagaaactagagacgtcagggaatgtcagcgttgatgaggatggaaagtatatcatgtcatttgccttgccaatacgatctctctcattagttgtggtggagcatgttgaagcaggcaacaagatttcctaa

SEQ ID NO: 261 - protein, 496 aa, M. phaseolina
MNRITVLSQRKQHICRKQCDSCAAASSRVHTEDSQGNSIYDWTFMDRVFDSYLSANVKPYVQIGFMPLALSAGPDPNFFTFTPTSSYDAIYTGWSSPPTNYQTWEELLYQWTKHNVEKYGQAEVESWYWEVWNEPNVAYWNGTRDEFCALHDHAIAAVRRALPTARVGGCEAAGGAAERLPRRAPEPQPARWQLRHRRDRHAALHQSHGAKEGGFVRMNLSAQLQQIDGAFSVGASFAELRQTPIVMGEYDPDGCAACQTPQYGYENGPLYQSYTIATFVRALDLADRWGVNRQGALTWAFEYEEAELFNDTTYFDGFRVLATQGIDKPVLNAHRMLGMMTRDRVWAESDGQVSLDEAVAGSVRGKTDVGVLASADEERVYVLVWYYHDNDTSFQDAQVDLTIGGLENRTSANLTHFRLDEEHSNSYSLWRALRSPTAPTPVDYERLVAAGKLEKLETSGNVSVDEDGKYIMSFALPIRSLSLVVVEHVEAGNKIS

SEQ ID NO: 262 - DNA, 1848 bp, M. phaseolina
cgtgcgtcttggctccgcgtatatatagagagagcccagcaggtcgagtttagttcctttttgttgtttttttgcctcgcaaagtaagcttatctccttcccgcccgccacacccgcaccacaatgccgcctcgcggcctcaggcacaacatgaaggcggcacttgtcctcctctgcagcgctgtcacgaccaccaccatggccgacttcaccaacccggtgctctgggaggacctggccgacctggacattttccgggtagacgacaccttctactactcagcctcgacaatggcgtactcgccgggcgcgccaatcctgcggtcctacgacctcgccaactgggagttcgtggggcacagcgtgccggtgctcgacttcggggacgcgtacgacctcaacggcgggcaagcttacgtgcaagggatctgggcgagcttctgcaactaccggccgtcgaacaagctgttctactggggcggctgcatccggtccgatctcaagacgcacatctacacggcatccgacgtggcaggcgagtggagcaagcacgccgtcatcgacacgtgctactacgacgccgggctgctggtcgacacagatgacacgctgtacgtcgcccatggcaacaccaacatctccgtcgcgcagctgtcggccgacggcacgggcgaggtcagcacgcaggtcgtgtacgagtcgcccatctacatcgaagggtcgcgcttctacaacatcaacggcacctactacatcttcctgacgcgcccgcccgatgccgagttcgtgctcaagtcgaccaacggccccctcggtccgtacgagggccgctacctcgtcgaccgggttgccgcgccggtcgacggggccggggcaccgcaccagggcggcattgtcgatacgcccggcggcgactggtactacatgtccttcatcgacgcgtacccgggcgggcgcatgccggtgctggcgcccatcacctgggacgatgacggctggccgtccgtcacgctcgatgccaacggcggctgggccgcgacctacccgtcgcccggcgtgcccacgccgccgcgcgaagtcgagtcgccggttggtgtcgacgaattctccggcacggccttgagccaccagtgggagtggaaccacaacccggacaacaccaagtggtcgctcgatggcggcttgcggctgcagacggccactgtgacggacgacctgtacgcagcgcggaatacgctgacgcacaggatcgtcggacccaagtcggcaggcaccattgtactggattactcgtccatggcagatggagaccgcgccggtctctcgctcttccgtgaccagtcggcctggatcggcatcatcaaggatgccggggctaccaagatcgcggtgtgggacgacattaccatggattcgagctggaacaccaacagcacaggatccgaagtggcgagcgcagacatctctggaagcagggtctggctgagggttgatgctgacatcgcgcctgctggcaccaagcaaggcgtcttctcgtacagcaccgacgggacgacctttaccaacctggggtccgcgttcaccatgaacacggcgtggcagtatttcatcggctaccgctttggcatcttcaacttcgctacgcaagcacttggagggtcggtcctggtagagtcgtttgaaatgcagctttcgtaggacataggcgctgaaatagatatctgaatggattctcctcaaacctaccttgtacacagcgggccgtcggacgtcactcagtcctgaatgtcctcgccgtcgccgatcatgtgcttgaaatcgcctaggatagtgttccacgagtcctcc

SEQ ID NO: 263 - DNA, 1548 bp, M. phaseolina
atgaaggcggcacttgtcctcctctgcagcgctgtcacgaccaccaccatggccgacttcaccaacccggtgctctgggaggacctggccgacctggacattttccgggtagacgacaccttctactactcagcctcgacaatggcgtactcgccgggcgcgccaatcctgcggtcctacgacctcgccaactgggagttcgtggggcacagcgtgccggtgctcgacttcggggacgcgtacgacctcaacggcgggcaagcttacgtgcaagggatctgggcgagcttctgcaactaccggccgtcgaacaagctgttctactggggcggctgcatccggtccgatctcaagacgcacatctacacggcatccgacgtggcaggcgagtggagcaagcacgccgtcatcgacacgtgctactacgacgccgggctgctggtcgacacagatgacacgctgtacgtcgcccatggcaacaccaacatctccgtcgcgcagctgtcggccgacggcacgggcgaggtcagcacgcaggtcgtgtacgagtcgcccatctacatcgaagggtcgcgcttctacaacatcaacggcacctactacatcttcctgacgcgcccgcccgatgccgagttcgtgctcaagtcgaccaacggccccctcggtccgtacgagggccgctacctcgtcgaccgggttgccgcgccggtcgacggggccggggcaccgcaccagggcggcattgtcgatacgcccggcggcgactggtactacatgtccttcatcgacgcgtacccgggcgggcgcatgccggtgctggcgcccatcacctgggacgatgacggctggccgtccgtcacgctcgatgccaacggcggctgggccgcgacctacccgtcgcccggcgtgcccacgccgccgcgcgaagtcgagtcgccggttggtgtcgacgaattctccggcacggccttgagccaccagtgggagtggaaccacaacccggacaacaccaagtggtcgctcgatggcggcttgcggctgcagacggccactgtgacggacgacctgtacgcagcgcggaatacgctgacgcacaggatcgtcggacccaagtcggcaggcaccattgtactggattactcgtccatggcagatggagaccgcgccggtctctcgctcttccgtgaccagtcggcctggatcggcatcatcaaggatgccggggctaccaagatcgcggtgtgggacgacattaccatggattcgagctggaacaccaacagcacaggatccgaagtggcgagcgcagacatctctggaagcagggtctggctgagggttgatgctgacatcgcgcctgctggcaccaagcaaggcgtcttctcgtacagcaccgacgggacgacctttaccaacctggggtccgcgttcaccatgaacacggcgtggcagtatttcatcggctaccgctttggcatcttcaacttcgctacgcaagcacttggagggtcggtcctggtagagtcgtttgaaatgcagctttcgtag

SEQ ID NO: 264 - protein, 515 aa, M. phaseolina
MKAALVLLCSAVTTTTMADFTNPVLWEDLADLDIFRVDDTFYYSASTMAYSPGAPILRSYDLANWEFVGHSVPVLDFGDAYDLNGGQAYVQGIWASFCNYRPSNKLFYWGGCIRSDLKTHIYTASDVAGEWSKHAVIDTCYYDAGLLVDTDDTLYVAHGNTNISVAQLSADGTGEVSTQVVYESPIYIEGSRFYNINGTYYIFLTRPPDAEFVLKSTNGPLGPYEGRYLVDRVAAPVDGAGAPHQGGIVDTPGGDWYYMSFIDAYPGGRMPVLAPITWDDDGWPSVTLDANGGWAATYPSPGVPTPPREVESPVGVDEFSGTALSHQWEWNHNPDNTKWSLDGGLRLQTATVTDDLYAARNTLTHRIVGPKSAGTIVLDYSSMADGDRAGLSLFRDQSAWIGIIKDAGATKIAVWDDITMDSSWNTNSTGSEVASADISGSRVWLRVDADIAPAGTKQGVFSYSTDGTTFTNLGSAFTMNTAWQYFIGYRFGIFNFATQALGGSVLVESFEMQLS

SEQ ID NO: 265 - DNA, 1860 bp, M. phaseolina
gcgccaccggcccgcccggccagcggctcaagggccgatattcctgcttgcacgatgttgatttcaccccaggcttgatataattgcaaccttccgtcgattgtggccttccacaacctggatcattcactcgctcaggacctcttcgtcatgaagcctgccatcgttctcgcggctattctgcccatatcctgggcggcaggcgcgactttctccaatccggtcgtgtacgaggatttcgctgacaatgacgtctcggttggaccggatggtctcttctacttctccgcatcgaatatgcactatagtcctggcgcacctatcctacgatcgtacgatcttgccaattgggagctcatcggccattctgtgccgagcctggattttggagagcggtacaacctgaccggcggccaggcctacaggggtggcacttgggcgtccacgatgcggtaccgtgaaagcaatggcctatggtactggattggatgcgtcgacttctggtacacgtatatctacaccagcaagtccccaacgggtccctggaccaggtctgcccagctacctggtggcacctgctactacgactgcggcctcttagtggatgacgacgacacgatgtatgtcgtctatggagctacggacgtcaaggttgctcagcttgctgccgacggactgagtgaagtgaagagccagggagtcttcagtgcttcggacgtgggacaggacggcatcgaggggaaccgcatgtacaagcgcaacggcaactactacatcctcaacgatcaccccggcgacaacacctacatctggaagtcatcgagcccatggggcccatacgccagcaagatactcgtccagaacatccagtcccccgtctccggcggcggtgccccccaccagggcagtctcgtcaagacagccgacgatgactggtactatatgtccttcacgtgggcctacccagccggccgcatgcccgtcctcggccccgtcacctggggcagcgatgatttccccgtctttgtcgacgggtccaacggcgggtggggcgtttcatacccactcccgctgcctgcgcacccgctcccgagctggacgggcactgacgcgttccgaggcacctccctgggccccgcgtgggagtggaaccataatccggacccgtccaagtacgccgtcaacaatggcctgaccctctcagctgccacggtcacggacgatctgtacgccgcgcgcaacaccctgacgcaccgcatccacggcgagttccccgtcgggaccgtggccatcgacttctcgaacctcgctgacggcgaccgtgccggtctggctgctttccgggaccgcagcgcctcgatcggcgtccaccgcgacggcgacacgtacaccatccaggtcgtgcacggcatgacgcaggacgagtcgacgtgggcgacaacgagcaaggggaccacagtggccacggcgccggtgcccggcggggcaaagaaggtgtggttgcgggcggcgctggatgcgcgcgcgagcgggacgaaggcggcgaacttctcctacagcttcgatggggacgagttcgagcagctggggcggccgtatacgatgtggacgaactgggcgtatttcatggggtatcggttcggcatcttcaactatgccaccaagaaacttggcggctccgtcgcggtctcttcgtttagtagtgcatagtttctgtgagggtgcgtgggagctccgttggggaagctctctcatctattagggttggattcgctcatcataatgcaagagaaatatataaacattaagacgatccaggctcaacgatggccggtattacatggagcagagagcaatgcg

SEQ ID NO: 266 - DNA, 1560 bp, M. phaseolina
atgaagcctgccatcgttctcgcggctattctgcccatatcctgggcggcaggcgcgactttctccaatccggtcgtgtacgaggatttcgctgacaatgacgtctcggttggaccggatggtctcttctacttctccgcatcgaatatgcactatagtcctggcgcacctatcctacgatcgtacgatcttgccaattgggagctcatcggccattctgtgccgagcctggattttggagagcggtacaacctgaccggcggccaggcctacaggggtggcacttgggcgtccacgatgcggtaccgtgaaagcaatggcctatggtactggattggatgcgtcgacttctggtacacgtatatctacaccagcaagtccccaacgggtccctggaccaggtctgcccagctacctggtggcacctgctactacgactgcggcctcttagtggatgacgacgacacgatgtatgtcgtctatggagctacggacgtcaaggttgctcagcttgctgccgacggactgagtgaagtgaagagccagggagtcttcagtgcttcggacgtgggacaggacggcatcgaggggaaccgcatgtacaagcgcaacggcaactactacatcctcaacgatcaccccggcgacaacacctacatctggaagtcatcgagcccatggggcccatacgccagcaagatactcgtccagaacatccagtcccccgtctccggcggcggtgccccccaccagggcagtctcgtcaagacagccgacgatgactggtactatatgtccttcacgtgggcctacccagccggccgcatgcccgtcctcggccccgtcacctggggcagcgatgatttccccgtctttgtcgacgggtccaacggcgggtggggcgtttcatacccactcccgctgcctgcgcacccgctcccgagctggacgggcactgacgcgttccgaggcacctccctgggccccgcgtgggagtggaaccataatccggacccgtccaagtacgccgtcaacaatggcctgaccctctcagctgccacggtcacggacgatctgtacgccgcgcgcaacaccctgacgcaccgcatccacggcgagttccccgtcgggaccgtggccatcgacttctcgaacctcgctgacggcgaccgtgccggtctggctgctttccgggaccgcagcgcctcgatcggcgtccaccgcgacggcgacacgtacaccatccaggtcgtgcacggcatgacgcaggacgagtcgacgtgggcgacaacgagcaaggggaccacagtggccacggcgccggtgcccggcggggcaaagaaggtgtggttgcgggcggcgctggatgcgcgcgcgagcgggacgaaggcggcgaacttctcctacagcttcgatggggacgagttcgagcagctggggcggccgtatacgatgtggacgaactgggcgtatttcatggggtatcggttcggcatcttcaactatgccaccaagaaacttggcggctccgtcgcggtctcttcgtttagtagtgcatag

SEQ ID NO: 267 - protein, 519 aa, M. phaseolina
MKPAIVLAAILPISWAAGATFSNPVVYEDFADNDVSVGPDGLFYFSASNMHYSPGAPILRSYDLANWELIGHSVPSLDFGERYNLTGGQAYRGGTWASTMRYRESNGLWYWIGCVDFWYTYIYTSKSPTGPWTRSAQLPGGTCYYDCGLLVDDDDTMYVVYGATDVKVAQLAADGLSEVKSQGVFSASDVGQDGIEGNRMYKRNGNYYILNDHPGDNTYIWKSSSPWGPYASKILVQNIQSPVSGGGAPHQGSLVKTADDDWYYMSFTWAYPAGRMPVLGPVTWGSDDFPVFVDGSNGGWGVSYPLPLPAHPLPSWTGTDAFRGTSLGPAWEWNHNPDPSKYAVNNGLTLSAATVTDDLYAARNTLTHRIHGEFPVGTVAIDFSNLADGDRAGLAAFRDRSASIGVHRDGDTYTIQVVHGMTQDESTWATTSKGTTVATAPVPGGAKKVWLRAALDARASGTKAANFSYSFDGDEFEQLGRPYTMWTNWAYFMGYRFGIFNYATKKLGGSVAVSSFSSA

SEQ ID NO: 268 - DNA, 3042 bp, M. phaseolina
cttccttgcggagaacaggactgatcccgccggttcctgcgtcccagccgcccatgccaccactcgctcggtgctatttaagcagccgcacgcggctcgacattgctgctcgctcacgcccttctcccaacactccatcctcccctagccatgccgttgcgcacaggcattgcaggcgttgccgctttggccgcccaggcttctgctgtgagccttacggccttcggctttcccgactgcgtcaatgggcccttgaaagacaacttggtctgcgacagctctgccagtgcgtgctatttctcatgcgctactccgtctgctctccctggaaactgactatactaccgtagctccccttgccagagcaaccgccctggtcaaggagcttacgctcgaggagaagctcaacaacactggcaacaccagccccggtgttccccgccttggcatccccgagtaccagtggtggaacgaaggtctgtaacgtcgtattatctcagcgtgacagatcgatgctgaccactcggccacagcactacacggcgtggcattcacctacccagggcagccaatgactgaatcgggcaatttttccagcgccacctcttttccccaacccatcctgatgggcgcagcctttgacgatgaattgatctacgaagttgccagcgtcgtgagcactgaggcaagagcatatagcaacggcggccggtctggcttggattactgggtaagtcgtgtaagaccctgtcgagttcgcagacaggctataccgccaacaactcctccacccgctgcaagtctcgagtgacactaacgacatgctacacagacaccgaacatcaatccatacaaagacccaagatggggccgcggtcagggtgagtacttactggtgttacttgagtgacgaaaatatcgatacgctgacaacttatacagaaacgcccggagaggatcccttccatctcgctagctacgtccagaacttgattcgtggtctggagggaaaccaaaatgacccgtacaagaagatcgtagccacgtgcaagcatttcaccggctacgatatggaaaactggaatggtaattttaggtaccaattcgatgcccagatcaacatgagagacatggtggagtattatatgcccccattccaggcatgtgcgagggaagcaaaggtcggtgccttcatgtgctcgtacaatgctgtaaacggagtgcccacttgtgcggacccgtggctgcttcagaccgtacttcgcgagcactggggctggaaccaggaagatcaatgggtcgtcagcgattgcgatgctatccagaacgtctatctgcctcatgagtgggccgagtcccgcgagcaggctgttgcagacaccttgaatgctggcacaggtatacagcttttcatactccctataccttcggcattggctgatttctcatttagatctcaactgtgggacctactaccagagatacttgcctggggcttacgagcaggggctcatcaacgacacgactcttgatagggctctgactcggacttactcctccctgatcaagctaggctattttgacaatgccgactcgcaaccataccgccagattggctggcaagacgtgaactcgcagcacgcgcaggagctcgccctcaaagctgcccaagaaggcatcgtgcttcttaagaatgatggccttcttcctctgtctctcgacggtgtctcctccatcgctctgattggctcgtgggccaacgccacggagcagatgcaaggcaactatgctggagtagcgccttatctccattctccgctgtatgcggccgagcagctcggcgtcaaggtcaactacgcagagggtgcttctcaaagcaaccccacaacagatcagtggggcgcggagtacaccgctgcagagaactcggacgtcatcatcgtcgtcggcggcatcgacaacgacatcgaaagcgaggaacttgaccgcgtagccatcgcctggtcaggtccgcagctggacatgatcaccaagctggcaacatacggcaagcccgtcatcgtcgtgcagatgggcgcaggccagctcgacagcacgccgctcgtctccaacgccaacatctccgccctcctttggggcggttacccgggccaagacggcggcaccgcgctctttgacatcatcaccggcgccgtggcgcccgccggccgcctgcccatcacccagtaccccgcgcgctacaccaaggaggtcgcaatgacggacatgtctttgcggccgtcctccaccagcgccggccgcacctacaagtggtacaacggcactgccgtcttccccttcggcttcggcctccactacaccaacttcagtgccgccataccttcccctcccgcctcatccttcgccatctccgacctcgtcgcctcgtgcagcgccaatgacacctccaaactcgacctctgccccttcacctccctcgccgtcgacattgccaacgacggcacccgcgcctctgacttcgtcgccctcgccttcttgaccggcgagttcggcccgtccccgcaccccaaatccagcctcgttgcctaccagcgcttgcacgccatcgccgcgggcgaaacgcagaccgcgcgcctcaacctcactcttggcagcttggtgcgtgtggatgaaaatggagacaagctgctgtatcccggcgactatagcgttttgattgacgtgccggacaagcctctggcgagcgtcaatttcacgctgacaggcgatgaggctggcactgtgattgagcgttggccgaggctgaacgcggataggaagggggctggagtggagaatgtgccggcggattattatgaaggtgggtttgggagtgagcaggaggtgttgtaaggggaagaattgtggctcgtgcgtcgtctgagaggaggtgggcagtgaccctgcgtccaatgtataatgtagaacttcctaatgtacgcaatgattgcgagtcaccaaaagctcgctatgtattgacacagatgaatgtaaacggccgcg

SEQ ID NO: 269 - DNA, 2403 bp, M. phaseolina
atgccgttgcgcacaggcattgcaggcgttgccgctttggccgcccaggcttctgctgtgagccttacggccttcggctttcccgactgcgtcaatgggcccttgaaagacaacttggtctgcgacagctctgccactccccttgccagagcaaccgccctggtcaaggagcttacgctcgaggagaagctcaacaacactggcaacaccagccccggtgttccccgccttggcatccccgagtaccagtggtggaacgaagcactacacggcgtggcattcacctacccagggcagccaatgactgaatcgggcaatttttccagcgccacctcttttccccaacccatcctgatgggcgcagcctttgacgatgaattgatctacgaagttgccagcgtcgtgagcactgaggcaagagcatatagcaacggcggccggtctggcttggattactggacaccgaacatcaatccatacaaagacccaagatggggccgcggtcaggaaacgcccggagaggatcccttccatctcgctagctacgtccagaacttgattcgtggtctggagggaaaccaaaatgacccgtacaagaagatcgtagccacgtgcaagcatttcaccggctacgatatggaaaactggaatggtaattttaggtaccaattcgatgcccagatcaacatgagagacatggtggagtattatatgcccccattccaggcatgtgcgagggaagcaaaggtcggtgccttcatgtgctcgtacaatgctgtaaacggagtgcccacttgtgcggacccgtggctgcttcagaccgtacttcgcgagcactggggctggaaccaggaagatcaatgggtcgtcagcgattgcgatgctatccagaacgtctatctgcctcatgagtgggccgagtcccgcgagcaggctgttgcagacaccttgaatgctggcacagatctcaactgtgggacctactaccagagatacttgcctggggcttacgagcaggggctcatcaacgacacgactcttgatagggctctgactcggacttactcctccctgatcaagctaggctattttgacaatgccgactcgcaaccataccgccagattggctggcaagacgtgaactcgcagcacgcgcaggagctcgccctcaaagctgcccaagaaggcatcgtgcttcttaagaatgatggccttcttcctctgtctctcgacggtgtctcctccatcgctctgattggctcgtgggccaacgccacggagcagatgcaaggcaactatgctggagtagcgccttatctccattctccgctgtatgcggccgagcagctcggcgtcaaggtcaactacgcagagggtgcttctcaaagcaaccccacaacagatcagtggggcgcggagtacaccgctgcagagaactcggacgtcatcatcgtcgtcggcggcatcgacaacgacatcgaaagcgaggaacttgaccgcgtagccatcgcctggtcaggtccgcagctggacatgatcaccaagctggcaacatacggcaagcccgtcatcgtcgtgcagatgggcgcaggccagctcgacagcacgccgctcgtctccaacgccaacatctccgccctcctttggggcggttacccgggccaagacggcggcaccgcgctctttgacatcatcaccggcgccgtggcgcccgccggccgcctgcccatcacccagtaccccgcgcgctacaccaaggaggtcgcaatgacggacatgtctttgcggccgtcctccaccagcgccggccgcacctacaagtggtacaacggcactgccgtcttccccttcggcttcggcctccactacaccaacttcagtgccgccataccttcccctcccgcctcatccttcgccatctccgacctcgtcgcctcgtgcagcgccaatgacacctccaaactcgacctctgccccttcacctccctcgccgtcgacattgccaacgacggcacccgcgcctctgacttcgtcgccctcgccttcttgaccggcgagttcggcccgtccccgcaccccaaatccagcctcgttgcctaccagcgcttgcacgccatcgccgcgggcgaaacgcagaccgcgcgcctcaacctcactcttggcagcttggtgcgtgtggatgaaaatggagacaagctgctgtatcccggcgactatagcgttttgattgacgtgccggacaagcctctggcgagcgtcaatttcacgctgacaggcgatgaggctggcactgtgattgagcgttggccgaggctgaacgcggataggaagggggctggagtggagaatgtgccggcggattattatgaaggtgggtttgggagtgagcaggaggtgttgtaa

SEQ ID NO: 270 - protein, 800 aa, M. phaseolina
MPLRTGIAGVAALAAQASAVSLTAFGFPDCVNGPLKDNLVCDSSATPLARATALVKELTLEEKLNNTGNTSPGVPRLGIPEYQWWNEALHGVAFTYPGQPMTESGNFSSATSFPQPILMGAAFDDELIYEVASVVSTEARAYSNGGRSGLDYWTPNINPYKDPRWGRGQETPGEDPFHLASYVQNLIRGLEGNQNDPYKKIVATCKHFTGYDMENWNGNFRYQFDAQINMRDMVEYYMPPFQACAREAKVGAFMCSYNAVNGVPTCADPWLLQTVLREHWGWNQEDQWVVSDCDAIQNVYLPHEWAESREQAVADTLNAGTDLNCGTYYQRYLPGAYEQGLINDTTLDRALTRTYSSLIKLGYFDNADSQPYRQIGWQDVNSQHAQELALKAAQEGIVLLKNDGLLPLSLDGVSSIALIGSWANATEQMQGNYAGVAPYLHSPLYAAEQLGVKVNYAEGASQSNPTTDQWGAEYTAAENSDVIIVVGGIDNDIESEELDRVAIAWSGPQLDMITKLATYGKPVIVVQMGAGQLDSTPLVSNANISALLWGGYPGQDGGTALFDIITGAVAPAGRLPITQYPARYTKEVAMTDMSLRPSSTSAGRTYKWYNGTAVFPFGFGLHYTNFSAAIPSPPASSFAISDLVASCSANDTSKLDLCPFTSLAVDIANDGTRASDFVALAFLTGEFGPSPHPKSSLVAYQRLHAIAAGETQTARLNLTLGSLVRVDENGDKLLYPGDYSVLIDVPDKPLASVNFTLTGDEAGTVIERWPRLNADRKGAGVENVPADYYEGGFGSEQEVL

SEQ ID NO: 271 - DNA, 3836 bp, M. phaseolina
aaacgggccggggcagtctctcagttctcgccatgtttcgcccacgaaggtgggatgtcttgccatgctttatagatgctgcgccccaaggaccatatcaaagcttaactgccatccccgacatttcgccttggccgccctaaccacaaaatgaggcctcgcagtgccgccgtctttttgcttaccttttcacacatcctccccggttgttgtttgcaaccgcgggaatccggcaatggaacgacaaccaaggatgcttttatcgacaacctagtttcgcagatgactgtcgcagaccttggtatgctactccatcaccagcgcagttcctccggtccttcccaaagcagcaaaaatcaaagactagggccagcgaagaatgtgtgtgtactgccttgcgcggcgtgataaagcagctcgaggatttctccacccgggtttcctcgtcctcagtttttttaccgccccgtaattgatccgtttcgacaaaagcattgaagttggatcttgccaaaaaaaaaaaaaaaaacatcacgaccagactctggatgaggaagtgcagatcgatcctatcccctgcattgaacgcaccagacgtccatctgaacccacaaactaacaatatgaacagtgctacagctccacttgatgttcggagacaatattgttgggcccagaagtcaaaatgagctctacggtgagcacacagctgcttctcttgatccattcactcattgaacatgcagacctcgccatgcgggctgccccagatgcagctgtgggaaacatacacgattggtctgccctcgtctcttctttatagacgtatgctaactcgaaacaggtaccccttgaatacgtcctactacaatggaatgcagcagctcgtagccaaaaaggcccgcctacatgtcccgtttttgcacttcggagaatgcttgcacggagtcggctcgtacaagcagtccatgtttcctcgtaatccaagccgcacccaattctggcccccgtgcatgttgctaagttatttcagaatccatcggtctttccgcctcctttgatgctgacctagtatatcgcgttggccgagctatcggcactgaagccaggtccatcggcgtccacgcttgcctctcccccgtactggatctttcgggaaaagagccccggttcggcaggctccaggaagcttggggtgaagataaggttctaacatccatcatgggtgttgcttatgcttccggcctttctaagaatggatcctggtctgatcccgatgccgtcgctcccgtgatgaagcactttgccgcttacggtgcaccgcaatcggggcttaatgccgcaccatggataggtcatggcaacagggagatactggaggagctccttatgcctttcaaagctgttgtcaacctcggcggcgttcggggcgtcatgatggcttacaacgagcttgatggcatccccgctcatgtttcaccgctgctataccaggctttagaggactgggaattcgatggctttgtaatgggagacgacttgggagtttcaatgttggaaggccgccatcaggtatcaactggcccagcagatactctcacggtaagttgatcttcttcaggaacccatgacctgcaaagttgactgaaccgctatagcaatggttcaacgccggtggaatgatccaattctacgactattccttggacgactttctgaataccacagcgggccttgtgtcaaatggcagcgtgccgctttcaaccctccaggctcacataaagaggatattgggagtgaagtacgatcttggtctattctcggactctcttatttcggactcaattgatccgcaggctattacggcctctcacgtcccacttactcgagaagcagcacataaaagcatagtgttgctggataatcacaattcgactctccctttaaagcccgcggaccaggggatccaaaagcttgcgctcataggtcccttcatcgacactctgaactgtggcgactactctgggaccttcggtgcatttcccgtggcaaactcatcaacacttctgcaggctgtgctggcacatacagcctcgctcgaatatccggtcgaactgataacggcatggggggcaaaccaatggttgtacaatcagcaagtccccattgccgggtaccacctctctccaccaaacagcagcaatagtagcggcggaggcgaggggctactcgcaacatattacgcagacacaaacttcacgacgccgcttgtccggactatcgaaacaccgttccttgattggggcctttatcctccatcaggtcttccgtcgaacaacttctccgcaatatgggaaggaatcatcaccgtgccctccacgctgaccgaggccgtggaaggctaccttggcgtggcagtctacgccaacaccaccgcaaccctctacatcgactcccaaccccttgtcacctccccactcaccacatccggcaacttcctctccaacatccagtcccgtacctgggcggccgtcaacagcaccgctgcacctcccggctccgcccccttcaccttccaccctggcgcccgccaccgcatccgcatcacctaccaagcgtacaacttgtaccaaaagatcgaaaaccagaacagcctcaacgcgcagatcctccttttctggaacctcgttgaccggcgccagcagcaacagcaacatcccgccaacagccctcccgcggccctggcgcaagccatctccgccgcccacgccgccgacgctatcatcctgcatctcggcagcggctggtcctccgacggcgagggcggcgaccgcgcctcgctctcgctgtcccccaaccaatccgcgctcgctgacgccgtctttggcgccgccgcctcggccaacaaacccgtcgtgctcgtcctgacgggcggcaggccgctcgcgatacccgagtactacaaccgatcgagcgcggtgctgcacacgttcttccccgggcagcagggcgggagtgccgtcgcggatgtgttgttcggggcggtgaatccgggcgggcggatgccggtgagtgtggcgaggggggtggggcagttgccggtgttctataattataagtgagtcttgcgagtgcttcgctcgtagcctttttgcttcggtcttcggggaggaagagcgtcactgacgatcggacggacaaggtacactgcgcgcgctgtcacgtacctggatgaagagaacacacctgcgtatcctttcggctatggcctcagctactcgaacttctccgcgggcgggttgactgcttctgttgtgcggaatggaagcgtcgttgctgatgggcctgcggcaacgttcgcagctggggattacttacggtttggtgttcctgtgagtaacgaggggcccgtgcctggcagctatgttgtacaggtgtatctactgcagcgtgtttcgcagattacgcagccggccaagcagctcgttgcattttcgaggctatacttggaggtcggggaggagaggacggtagatctggaggttgaggttgacagatatctgaggatattggataggaagatggaatggcgagtggagagcggtgaatatacgtttgcggtgctgagtgatggtggtgtaacggcggagcaggcagggaacgtcacgatgaggtgcaccgaataagcacgtcggtgggtttgttgttttggcatggactcgggcgaggggaaagtcagtgtatcagcgaaagtgggtggtagggctgtggcttgcacctttaagaacgaggccaccggcttaggtccgagtattcggctttttgtgtagtagttt

SEQ ID NO: 272 - DNA, 2916 bp, M. phaseolina
atgaggcctcgcagtgccgccgtctttttgcttaccttttcacacatcctccccggttgttgtttgcaaccgcgggaatccggcaatggaacgacaaccaaggatgcttttatcgacaacctagtttcgcagatgactgtcgcagaccttgtgctacagctccacttgatgttcggagacaatattgttgggcccagaagtcaaaatgagctctacgacctcgccatgcgggctgccccagatgcagctgtgggaaacatacacgattggtaccccttgaatacgtcctactacaatggaatgcagcagctcgtagccaaaaaggcccgcctacatgtcccgtttttgcacttcggagaatgcttgcacggagtcggctcgtacaagcagtccatgtttcctcaatccatcggtctttccgcctcctttgatgctgacctagtatatcgcgttggccgagctatcggcactgaagccaggtccatcggcgtccacgcttgcctctcccccgtactggatctttcgggaaaagagccccggttcggcaggctccaggaagcttggggtgaagataaggttctaacatccatcatgggtgttgcttatgcttccggcctttctaagaatggatcctggtctgatcccgatgccgtcgctcccgtgatgaagcactttgccgcttacggtgcaccgcaatcggggcttaatgccgcaccatggataggtcatggcaacagggagatactggaggagctccttatgcctttcaaagctgttgtcaacctcggcggcgttcggggcgtcatgatggcttacaacgagcttgatggcatccccgctcatgtttcaccgctgctataccaggctttagaggactgggaattcgatggctttgtaatgggagacgacttgggagtttcaatgttggaaggccgccatcaggtatcaactggcccagcagatactctcacgcaatggttcaacgccggtggaatgatccaattctacgactattccttggacgactttctgaataccacagcgggccttgtgtcaaatggcagcgtgccgctttcaaccctccaggctcacataaagaggatattgggagtgaagtacgatcttggtctattctcggactctcttatttcggactcaattgatccgcaggctattacggcctctcacgtcccacttactcgagaagcagcacataaaagcatagtgttgctggataatcacaattcgactctccctttaaagcccgcggaccaggggatccaaaagcttgcgctcataggtcccttcatcgacactctgaactgtggcgactactctgggaccttcggtgcatttcccgtggcaaactcatcaacacttctgcaggctgtgctggcacatacagcctcgctcgaatatccggtcgaactgataacggcatggggggcaaaccaatggttgtacaatcagcaagtccccattgccgggtaccacctctctccaccaaacagcagcaatagtagcggcggaggcgaggggctactcgcaacatattacgcagacacaaacttcacgacgccgcttgtccggactatcgaaacaccgttccttgattggggcctttatcctccatcaggtcttccgtcgaacaacttctccgcaatatgggaaggaatcatcaccgtgccctccacgctgaccgaggccgtggaaggctaccttggcgtggcagtctacgccaacaccaccgcaaccctctacatcgactcccaaccccttgtcacctccccactcaccacatccggcaacttcctctccaacatccagtcccgtacctgggcggccgtcaacagcaccgctgcacctcccggctccgcccccttcaccttccaccctggcgcccgccaccgcatccgcatcacctaccaagcgtacaacttgtaccaaaagatcgaaaaccagaacagcctcaacgcgcagatcctccttttctggaacctcgttgaccggcgccagcagcaacagcaacatcccgccaacagccctcccgcggccctggcgcaagccatctccgccgcccacgccgccgacgctatcatcctgcatctcggcagcggctggtcctccgacggcgagggcggcgaccgcgcctcgctctcgctgtcccccaaccaatccgcgctcgctgacgccgtctttggcgccgccgcctcggccaacaaacccgtcgtgctcgtcctgacgggcggcaggccgctcgcgatacccgagtactacaaccgatcgagcgcggtgctgcacacgttcttccccgggcagcagggcgggagtgccgtcgcggatgtgttgttcggggcggtgaatccgggcgggcggatgccggtgagtgtggcgaggggggtggggcagttgccggtgttctataattataagtacactgcgcgcgctgtcacgtacctggatgaagagaacacacctgcgtatcctttcggctatggcctcagctactcgaacttctccgcgggcgggttgactgcttctgttgtgcggaatggaagcgtcgttgctgatgggcctgcggcaacgttcgcagctggggattacttacggtttggtgttcctgtgagtaacgaggggcccgtgcctggcagctatgttgtacaggtgtatctactgcagcgtgtttcgcagattacgcagccggccaagcagctcgttgcattttcgaggctatacttggaggtcggggaggagaggacggtagatctggaggttgaggttgacagatatctgaggatattggataggaagatggaatggcgagtggagagcggtgaatatacgtttgcggtgctgagtgatggtggtgtaacggcggagcaggcagggaacgtcacgatgaggtgcaccgaataa

SEQ ID NO: 273 - protein, 971 aa, M. phaseolina
MRPRSAAVFLLTFSHILPGCCLQPRESGNGTTTKDAFIDNLVSQMTVADLVLQLHLMFGDNIVGPRSQNELYDLAMRAAPDAAVGNIHDWYPLNTSYYNGMQQLVAKKARLHVPFLHFGECLHGVGSYKQSMFPQSIGLSASFDADLVYRVGRAIGTEARSIGVHACLSPVLDLSGKEPRFGRLQEAWGEDKVLTSIMGVAYASGLSKNGSWSDPDAVAPVMKHFAAYGAPQSGLNAAPWIGHGNREILEELLMPFKAVVNLGGVRGVMMAYNELDGIPAHVSPLLYQALEDWEFDGFVMGDDLGVSMLEGRHQVSTGPADTLTQWFNAGGMIQFYDYSLDDFLNTTAGLVSNGSVPLSTLQAHIKRILGVKYDLGLFSDSLISDSIDPQAITASHVPLTREAAHKSIVLLDNHNSTLPLKPADQGIQKLALIGPFIDTLNCGDYSGTFGAFPVANSSTLLQAVLAHTASLEYPVELITAWGANQWLYNQQVPIAGYHLSPPNSSNSSGGGEGLLATYYADTNFTTPLVRTIETPFLDWGLYPPSGLPSNNFSAIWEGIITVPSTLTEAVEGYLGVAVYANTTATLYIDSQPLVTSPLTTSGNFLSNIQSRTWAAVNSTAAPPGSAPFTFHPGARHRIRITYQAYNLYQKIENQNSLNAQILLFWNLVDRRQQQQQHPANSPPAALAQAISAAHAADAIILHLGSGWSSDGEGGDRASLSLSPNQSALADAVFGAAASANKPVVLVLTGGRPLAIPEYYNRSSAVLHTFFPGQQGGSAVADVLFGAVNPGGRMPVSVARGVGQLPVFYNYKYTARAVTYLDEENTPAYPFGYGLSYSNFSAGGLTASVVRNGSVVADGPAATFAAGDYLRFGVPVSNEGPVPGSYVVQVYLLQRVSQITQPAKQLVAFSRLYLEVGEERTVDLEVEVDRYLRILDRKMEWRVESGEYTFAVLSDGGVTAEQAGNVTMRCTE

SEQ ID NO: 274 - DNA, 1278 bp, M. phaseolina
cacgccccgcggcagcttccacgacatcataaaagaacttcaagtgccaaatcgaggcatgaattaagaaaacacgcatccgctaaatcaacactctaccagtcccttgtgcgtcctttgacccacgtctctgcagtgcagatcagcagcatggctccggatccgctagtcacccacatctacaccgcagacccatcagcgcacgtgttcgaagggaaactctacatctatccgtcgcacgaccgggaaacggatatcaaattcaacgacaacggcgaccagtatgacatgaacgactaccacgtgctctcactcgaggcacccggcggcccggccactgaccacggagttgcgctgagagcggaggacgtgccatgggtttcgaagcagctgtgggcacccgacgctgctaccaagaacggcaactactatctctactttccggcacgcgacaaggagggaatcttccgcattggcgttgctgtgtcagactcgccatcgggccctttcaagccagaaccagagccaatcaagggatcttacagcatcgacccggccagctttgtggatgacgatggcagcgcctacctgtactttgggggcatctggggtggccagctgcagtgttggcgggcagacggcacttttgacccctcgcagtcgggtccgcacgagccgtccggcgccggtgtgcctgcgctgcttccacgagtggctcgcctgcgggacgatatgctggagtttgacagcccgccgcaggagctgctgctcctcgacgaatcaacggggaagcctctggcagcggatgaccacgatcggcgcttcttcgaagctgcatggatgcacaaataccagggcaaatactacttctcctactcgacgggcgatacgcactacctggtctacgccaccggagacagcccgctcgggccgttcacgtaccaaggaaggatcctggagccagtgctgggttggacaacgcatcattccattgccgaattcaagggaaaatggtatctattctaccatgactgctccttgtcgggaggcgttgatcatttgcgaagcgtgaagatgcgggagatattttacgatgctgaagggaggattaagctgactccagagtagccatttcaatttggatcaacttagaagaggaggagagattatcagcactggatggcatgacctcatttgcatatttgggcaagattcgttgcctccaatccacatgggacaatccaaacgctgaaaattaaaaaaaaaaaaaaaaaaaaa

SEQ ID NO: 275 - DNA, 978 bp, M. phaseolina
atggctccggatccgctagtcacccacatctacaccgcagacccatcagcgcacgtgttcgaagggaaactctacatctatccgtcgcacgaccgggaaacggatatcaaattcaacgacaacggcgaccagtatgacatgaacgactaccacgtgctctcactcgaggcacccggcggcccggccactgaccacggagttgcgctgagagcggaggacgtgccatgggtttcgaagcagctgtgggcacccgacgctgctaccaagaacggcaactactatctctactttccggcacgcgacaaggagggaatcttccgcattggcgttgctgtgtcagactcgccatcgggccctttcaagccagaaccagagccaatcaagggatcttacagcatcgacccggccagctttgtggatgacgatggcagcgcctacctgtactttgggggcatctggggtggccagctgcagtgttggcgggcagacggcacttttgacccctcgcagtcgggtccgcacgagccgtccggcgccggtgtgcctgcgctgcttccacgagtggctcgcctgcgggacgatatgctggagtttgacagcccgccgcaggagctgctgctcctcgacgaatcaacggggaagcctctggcagcggatgaccacgatcggcgcttcttcgaagctgcatggatgcacaaataccagggcaaatactacttctcctactcgacgggcgatacgcactacctggtctacgccaccggagacagcccgctcgggccgttcacgtaccaaggaaggatcctggagccagtgctgggttggacaacgcatcattccattgccgaattcaagggaaaatggtatctattctaccatgactgctccttgtcgggaggcgttgatcatttgcgaagcgtgaagatgcgggagatattttacgatgctgaagggaggattaagctgactccagagtag

SEQ ID NO: 276 - protein, 325 aa, M. phaseolina
MAPDPLVTHIYTADPSAHVFEGKLYIYPSHDRETDIKFNDNGDQYDMNDYHVLSLEAPGGPATDHGVALRAEDVPWVSKQLWAPDAATKNGNYYLYFPARDKEGIFRIGVAVSDSPSGPFKPEPEPIKGSYSIDPASFVDDDGSAYLYFGGIWGGQLQCWRADGTFDPSQSGPHEPSGAGVPALLPRVARLRDDMLEFDSPPQELLLLDESTGKPLAADDHDRRFFEAAWMHKYQGKYYFSYSTGDTHYLVYATGDSPLGPFTYQGRILEPVLGWTTHHSIAEFKGKWYLFYHDCSLSGGVDHLRSVKMREIFYDAEGRIKLTPE

SEQ ID NO: 277 - DNA, 2078 bp, M. phaseolina
tacgaaaaatcggcgcgaatacggaaagtggtggtaaatccagctgattcccttgttcaaagtcgataaagagggacgtgctagcttgtcaacttagaaatacattccacttcaatcacaggctgtaagacctacctccgttcaataaccatgatttccaaatcactgctctttgtgtgggctgctatcgttacggttgccgtccatgcggattcctacattaatcctgtgcttccaggcttccaccccgacccttcctgtatctacgttgaggaacaaaatcagactttcttctgcgcaacttccagtttcagtgttttccccggcatcccgattcatgccagcagagaccttacgaactggaagctggccagcaacgtcctgaaccgccgatcccagctccctgagttcgcctccacccccaccggccaagatggtattttcgcacccacgctccgctacaacaacggcaccttctacctgatcacaagctgggtctccgtcacctcgtaccagaacttcaagatggacaacatcatcttcacgaccaccgaccctttcaactctgcctcctggagcgaccccacgcacttcgacttcctcggctacgaccccagcctcttctgggacacggacggcgtcgcctatctcaccggcgcgcgcgcgaccaccaccggcacagccatcgctctcgccccgttcgacccttccaccggagcctacctcggaaaaactacctatccgtacgttgatgccgtccccatccgcctctcaatgccgagcatctactgataatgcacagctacaacggcaccggcatcggaacccctgagggtccgcacctctaccacaacaccgcctccggttggtactacctcctcatcgccgaaggcgggaccgctgcccggcaccgcggctccatcgcgcggtcccgcagcgtcgccggcccgtacgaggattgcccgcacaacccagtcgtgcacgccgcgagcaatgcgagtctgatacagagcgtcggacacgccgatatctttcaggacggcaacggtcagtggtggggcgttgcgctggcgcagcgggcaggcgggaggggatttgagagcgttcccatggggagagagacggtcttatttccggtacagtggagtgaagacgggtggctgaaagttgagggcgaggtggagggtgtgatggagggcccacttccacgagagagcagggagggcgtgtggcacgatgaacccgatattgtggacttcgagccaggcatgacactgccaccgcatttcgtgcacgtgcgggtgccggttgaagatgcgtacgtggtgggccctttggggagagagggcagcttggagttggtgccgagcgtaaggagcttgtcgaccaaggggggtggaaatacaacagaggggacaacgttcgtcgggagaaggcaggttgacacgctgttcacatacagcgtagatttggaatttgatccgagacggattggtgatgaggcgggcgtaacggtgtatctggatgagaccaggcatatcgatttgggcgttctgatgactgaggatggaggaaagcatctccggttgagggctgtgagctcaaaccataacacgacgacacacaaagatattaacgcggcgtggccaagcaaaaacgggaaagctcgattggagattcgagcagcgaacattacgcactacaccttctctgctgggatatcgccatacaagatgggagagcatacggacaccgctgtcataggatgtgtagaggcaagtcttgtgaccggcggatacacaggaacattgattggaacctacgccacaagcaacgcaatggagggtaaaaataccgcaaaggcatacgttagtagatggagatatcaggggcaaggtcaggagatcgggaacggccatattgtttgagttcatggagaacgtatagcccatgaaattacatgttgctgtcaaattctactcaaaaaataaaaacaagaatctgatcatctctttctaagttctccaagtgtccattcaatgggaaatctaacccttatccagtcacctctgctgtag

SEQ ID NO: 278 - DNA, 1731 bp, M. phaseolina
atgatttccaaatcactgctctttgtgtgggctgctatcgttacggttgccgtccatgcggattcctacattaatcctgtgcttccaggcttccaccccgacccttcctgtatctacgttgaggaacaaaatcagactttcttctgcgcaacttccagtttcagtgttttccccggcatcccgattcatgccagcagagaccttacgaactggaagctggccagcaacgtcctgaaccgccgatcccagctccctgagttcgcctccacccccaccggccaagatggtattttcgcacccacgctccgctacaacaacggcaccttctacctgatcacaagctgggtctccgtcacctcgtaccagaacttcaagatggacaacatcatcttcacgaccaccgaccctttcaactctgcctcctggagcgaccccacgcacttcgacttcctcggctacgaccccagcctcttctgggacacggacggcgtcgcctatctcaccggcgcgcgcgcgaccaccaccggcacagccatcgctctcgccccgttcgacccttccaccggagcctacctcggaaaaactacctatccgataatgcacagctacaacggcaccggcatcggaacccctgagggtccgcacctctaccacaacaccgcctccggttggtactacctcctcatcgccgaaggcgggaccgctgcccggcaccgcggctccatcgcgcggtcccgcagcgtcgccggcccgtacgaggattgcccgcacaacccagtcgtgcacgccgcgagcaatgcgagtctgatacagagcgtcggacacgccgatatctttcaggacggcaacggtcagtggtggggcgttgcgctggcgcagcgggcaggcgggaggggatttgagagcgttcccatggggagagagacggtcttatttccggtacagtggagtgaagacgggtggctgaaagttgagggcgaggtggagggtgtgatggagggcccacttccacgagagagcagggagggcgtgtggcacgatgaacccgatattgtggacttcgagccaggcatgacactgccaccgcatttcgtgcacgtgcgggtgccggttgaagatgcgtacgtggtgggccctttggggagagagggcagcttggagttggtgccgagcgtaaggagcttgtcgaccaaggggggtggaaatacaacagaggggacaacgttcgtcgggagaaggcaggttgacacgctgttcacatacagcgtagatttggaatttgatccgagacggattggtgatgaggcgggcgtaacggtgtatctggatgagaccaggcatatcgatttgggcgttctgatgactgaggatggaggaaagcatctccggttgagggctgtgagctcaaaccataacacgacgacacacaaagatattaacgcggcgtggccaagcaaaaacgggaaagctcgattggagattcgagcagcgaacattacgcactacaccttctctgctgggatatcgccatacaagatgggagagcatacggacaccgctgtcataggatgtgtagaggcaagtcttgtgaccggcggatacacaggaacattgattggaacctacgccacaagcaacgcaatggagggtaaaaataccgcaaaggcatacgttagtagatggagatatcaggggcaaggtcaggagatcgggaacggccatattgtttga

SEQ ID NO: 279 - protein, 576 aa, M. phaseolina
MISKSLLFVWAAIVTVAVHADSYINPVLPGFHPDPSCIYVEEQNQTFFCATSSFSVFPGIPIHASRDLTNWKLASNVLNRRSQLPEFASTPTGQDGIFAPTLRYNNGTFYLITSWVSVTSYQNFKMDNIIFTTTDPFNSASWSDPTHFDFLGYDPSLFWDTDGVAYLTGARATTTGTAIALAPFDPSTGAYLGKTTYPIMHSYNGTGIGTPEGPHLYHNTASGWYYLLIAEGGTAARHRGSIARSRSVAGPYEDCPHNPVVHAASNASLIQSVGHADIFQDGNGQWWGVALAQRAGGRGFESVPMGRETVLFPVQWSEDGWLKVEGEVEGVMEGPLPRESREGVWHDEPDIVDFEPGMTLPPHFVHVRVPVEDAYVVGPLGREGSLELVPSVRSLSTKGGGNTTEGTTFVGRRQVDTLFTYSVDLEFDPRRIGDEAGVTVYLDETRHIDLGVLMTEDGGKHLRLRAVSSNHNTTTHKDINAAWPSKNGKARLEIRAANITHYTFSAGISPYKMGEHTDTAVIGCVEASLVTGGYTGTLIGTYATSNAMEGKNTAKAYVSRWRYQGQGQEIGNGHIV

SEQ ID NO: 280 - DNA, 2097 bp, M. phaseolina
ctaaatatgctgattctttgccggccggcttccttccgatcccacggtgtttccgagatctcggaacgaccgcatttttaaaagtgctggtatgctactgcaggctccctttgcatcagccatcaattgtgaacgaaaccgcggtcgaagatgctcttcacacgggccgcgctcgccgcagccctggccttcattgcgccaacaagctctgctcccgtcaattccaccatcaactccacctacaccaacccgatcctgcccgggtggcattccgacccaacctgcgtcttcgtaccagagtttgatgacacatttttctgcacggtctcgaccttcctcgggttccctggcttgcccctctacgccagcaaggacctcctgaactggaaacacgcctccaacaccttctcgcggccctcccagttccccgacctcgccaacgccacctaccaacaaggcggcgtcttcgcgcccacgctccgctaccgcaacggcaccttctacaccatcgtcgtcaccgtagaccccctcgtcggcctcatcttcacgacgaccgacccctactcctccgccgcctggtccgaccccgtccgcttcgacgccgtcagcatcgacgcggacctcttctgggacgacgatgtcgacgggcaggcctacgtctccttcgcgggcatccagcaagccaagatcgacgtcgagacgggggcgcgcggcgccaattacagcgtctggaacggcacgggcgggccctcgcccgaggggccgcacgtctacaagaaggacggctggtactacctcatgattgccgagggcgggaccgagcttggccacaccgaaatcatcgcgcgctcgaggaacgtctccggcccgtacgagagctatgccggtaatccgatcctgacgaacaggaacactaccgagtacttccagacggtcggccatgcggatctgttccaggacggcaacggccagtggtggggcgtggcgctgagcacgcggtccggcccggagtgggtgaactatccgatgggcagggaaacggtgctgttcccggcgacgtgggaggagggcgagtggccggtgctgcagccggtgaggggccacatgagcggctggccgttgccgccggcgtccagggacctgccgggagaggggcagtgggtgggggatgcggatgttgtcgatttcgagcctggagagagcgtgccaccgcatttcatgtcgtggaggtttgcgcccgagggcgctttcaccgtcggcgcggaggagaagccgaatgccctgaaggtgttgccgtcgaaggcgaacttgacgggtggttcggattttcagcctcgcgacggcatttcattcctcgcgagaaggcagacggacacgctgtttgagtacagtgttgacgtcgagatcgatgcggaggttgaagaggaggaggctggtgctactgtattcttgacgcaagaccaacacttggatctcggtgttgtcctgctcgcatcgaaagggtcgtccgaactcgccccacactttagattccgtgtgaatggcacaggcaacaacgaaggccctgcaccgccgaccgttgttgagccagttccagaagcgtggttgggtcagccattacgcctacagatccgggctgccaacgacacccattacaccttctccgctggaccttcgggcgaggctgagccagccagggtgcttgcctatgcacctgctacgattgttagcgctggtaccggacctttcactggtaagttacacatttcctgctcggttggaatcctcttgcagtttgctgattgtacttcaggcgctttagtaggtgtatatgcgacaagcaacggtggttctgggacgacgcctgcctacttcagcagatggagatatgaaggcaagggtcagaaaatagccgagggagaaatcatcccctccacctcaagatgaattgttaggcggggagacttgaagaagtcgagagtggcgtatctttgatgataggcgtttttctagtgaatgaatgaccaaggagtgaggtgctaaatgcatgaggccaaaaagaaaaccaaaaaaaacaaaaaaaaagaaaagcaaaat

SEQ ID NO: 281 - DNA, 1737 bp, M. phaseolina
atgctcttcacacgggccgcgctcgccgcagccctggccttcattgcgccaacaagctctgctcccgtcaattccaccatcaactccacctacaccaacccgatcctgcccgggtggcattccgacccaacctgcgtcttcgtaccagagtttgatgacacatttttctgcacggtctcgaccttcctcgggttccctggcttgcccctctacgccagcaaggacctcctgaactggaaacacgcctccaacaccttctcgcggccctcccagttccccgacctcgccaacgccacctaccaacaaggcggcgtcttcgcgcccacgctccgctaccgcaacggcaccttctacaccatcgtcgtcaccgtagaccccctcgtcggcctcatcttcacgacgaccgacccctactcctccgccgcctggtccgaccccgtccgcttcgacgccgtcagcatcgacgcggacctcttctgggacgacgatgtcgacgggcaggcctacgtctccttcgcgggcatccagcaagccaagatcgacgtcgagacgggggcgcgcggcgccaattacagcgtctggaacggcacgggcgggccctcgcccgaggggccgcacgtctacaagaaggacggctggtactacctcatgattgccgagggcgggaccgagcttggccacaccgaaatcatcgcgcgctcgaggaacgtctccggcccgtacgagagctatgccggtaatccgatcctgacgaacaggaacactaccgagtacttccagacggtcggccatgcggatctgttccaggacggcaacggccagtggtggggcgtggcgctgagcacgcggtccggcccggagtgggtgaactatccgatgggcagggaaacggtgctgttcccggcgacgtgggaggagggcgagtggccggtgctgcagccggtgaggggccacatgagcggctggccgttgccgccggcgtccagggacctgccgggagaggggcagtgggtgggggatgcggatgttgtcgatttcgagcctggagagagcgtgccaccgcatttcatgtcgtggaggtttgcgcccgagggcgctttcaccgtcggcgcggaggagaagccgaatgccctgaaggtgttgccgtcgaaggcgaacttgacgggtggttcggattttcagcctcgcgacggcatttcattcctcgcgagaaggcagacggacacgctgtttgagtacagtgttgacgtcgagatcgatgcggaggttgaagaggaggaggctggtgctactgtattcttgacgcaagaccaacacttggatctcggtgttgtcctgctcgcatcgaaagggtcgtccgaactcgccccacactttagattccgtgtgaatggcacaggcaacaacgaaggccctgcaccgccgaccgttgttgagccagttccagaagcgtggttgggtcagccattacgcctacagatccgggctgccaacgacacccattacaccttctccgctggaccttcgggcgaggctgagccagccagggtgcttgcctatgcacctgctacgattgttagcgctggtaccggacctttcactggcgctttagtaggtgtatatgcgacaagcaacggtggttctgggacgacgcctgcctacttcagcagatggagatatgaaggcaagggtcagaaaatagccgagggagaaatcatcccctccacctcaagatga

SEQ ID NO: 282 - protein, 578 aa, M. phaseolina
MLFTRAALAAALAFIAPTSSAPVNSTINSTYTNPILPGWHSDPTCVFVPEFDDTFFCTVSTFLGFPGLPLYASKDLLNWKHASNTFSRPSQFPDLANATYQQGGVFAPTLRYRNGTFYTIVVTVDPLVGLIFTTTDPYSSAAWSDPVRFDAVSIDADLFWDDDVDGQAYVSFAGIQQAKIDVETGARGANYSVWNGTGGPSPEGPHVYKKDGWYYLMIAEGGTELGHTEIIARSRNVSGPYESYAGNPILTNRNTTEYFQTVGHADLFQDGNGQWWGVALSTRSGPEWVNYPMGRETVLFPATWEEGEWPVLQPVRGHMSGWPLPPASRDLPGEGQWVGDADVVDFEPGESVPPHFMSWRFAPEGAFTVGAEEKPNALKVLPSKANLTGGSDFQPRDGISFLARRQTDTLFEYSVDVEIDAEVEEEEAGATVFLTQDQHLDLGVVLLASKGSSELAPHFRFRVNGTGNNEGPAPPTVVEPVPEAWLGQPLRLQIRAANDTHYTFSAGPSGEAEPARVLAYAPATIVSAGTGPFTGALVGVYATSNGGSGTTPAYFSRWRYEGKGQKIAEGEIIPSTSR

SEQ ID NO: 283 - DNA, 2099 bp, M. phaseolina
ccggtgggaggaggcgcttcggtatgcatgacgatcatggcgggagcgaagctgccttgcacccttaggatcggcggctacaaaagcatgcaatctctctcaaacacttagtcgcttgcgtttccacccgcaggaagcatcttccttgcaatggagctccgcactctgctctctcctttcttcctctttgcggcgcctctggtcttgtgctcaactggtgagagttcgacatataccaaccccatcttaccaggcttccatccagatccaagctgcatcctggttgccgaatggaaccatactactttttgtgccagctcgagcttcctggccttccctgggattcctatccatgctagcagagacctcctgaactggaagctgataggcaatgccctgaatcgtccagagcagcttcctgagctggccaataccagcaggcagactagcggcatctgggctccgaccatcagatatcacaaaggtacattttacgttgtgaccactctggtccatgatgatcgagacgctttcgatccacagcggtgggacaacgtcattttctcgtccaaggatccttacgatgacgcggcctggtctgatgctgttcatttcgctttcgaaggttatgacaccagtccattctgggatgacgacggccaagtctacatgaccgcttcacatgcatacaaagttcggcctggaatcgaccaaatgaccatcgacctagagactggagagacgggggagcctgtcaatctttggaacgggaccggaggactagctcccgagggcccacatgtgtacaaaaaagacgggctttactacttgatggttgctgagggtgggactggtctgaaccacatgcagacgattgcccgatccgcttccgtcaacggcccgtaccatgcataccaggggaatcccatcctgtcaaatgcgaacacgacggagtattttcagactgtcggtcacgcggacctattccaagacacagcagggagctggtggggtgtcgcactggctacgcgctcaggtccagaatttttgacgtacccaatggggcgtgaaactgtgctctttcccgtgacctggactgaaggggaatggcctgtcctttctccagtcagaggccggatggaaggatggccccttccaccaccagatcactccattgcggggactgatcctttcatctcctctcctgatatcgtcgatttcgagcctggatcggcccttcctctccacttcctacattggcgatttccacgcgcagatgcgtacgagatttcaccgcctggtcacgactatagcctgaggttgaagccttcaaagctgaatctgacatcatacgatggacaaaatgctacggaagatcagactttgttggccaggcgtcaagttgacacattatttacatttagtgttgatgtcacattttcgccacaacaacaagaggaagaagcgggagtaagcgtgtttctaacacagaaccatcacatcgaccttggcattgtgttgctacccttgcaaaatgactcagatacatctccaaccctgaagccccacttccgcttccgcgcgacaagctatgttgccgtgcctgatccggtagtggtgcctgtgcctgacgcctggctgaaccaatctttgaggctggaaattaaggcatccaacgtaacacattacgccttctctgccgggccgactgcacatcagtcgcagatgatgacagtggcctatggagccggaagtctggtcagttggggtttcactggtgagtgctcgcttagagggttaaacatcgtcttttctgataggcgaaggctaatacggctattatagggacgctagtcggcgtatatgctactactaacggcggaaacggcacaacagatgcatatgtgagccgatggaggtatcagggtcagggtcaatttattgattgaaggttatgttggatatcacaatcttttgatgcccttcagggccgactaccgacgcgagcgctcatgtgtcgaaaattcgctgccctcgctctattctcgctaggattaaataattatgtcagtcttctggcaactcataacaatagagct

SEQ ID NO: 284 - DNA, 1731 bp, M. phaseolina
atggagctccgcactctgctctctcctttcttcctctttgcggcgcctctggtcttgtgctcaactggtgagagttcgacatataccaaccccatcttaccaggcttccatccagatccaagctgcatcctggttgccgaatggaaccatactactttttgtgccagctcgagcttcctggccttccctgggattcctatccatgctagcagagacctcctgaactggaagctgataggcaatgccctgaatcgtccagagcagcttcctgagctggccaataccagcaggcagactagcggcatctgggctccgaccatcagatatcacaaaggtacattttacgttgtgaccactctggtccatgatgatcgagacgctttcgatccacagcggtgggacaacgtcattttctcgtccaaggatccttacgatgacgcggcctggtctgatgctgttcatttcgctttcgaaggttatgacaccagtccattctgggatgacgacggccaagtctacatgaccgcttcacatgcatacaaagttcggcctggaatcgaccaaatgaccatcgacctagagactggagagacgggggagcctgtcaatctttggaacgggaccggaggactagctcccgagggcccacatgtgtacaaaaaagacgggctttactacttgatggttgctgagggtgggactggtctgaaccacatgcagacgattgcccgatccgcttccgtcaacggcccgtaccatgcataccaggggaatcccatcctgtcaaatgcgaacacgacggagtattttcagactgtcggtcacgcggacctattccaagacacagcagggagctggtggggtgtcgcactggctacgcgctcaggtccagaatttttgacgtacccaatggggcgtgaaactgtgctctttcccgtgacctggactgaaggggaatggcctgtcctttctccagtcagaggccggatggaaggatggccccttccaccaccagatcactccattgcggggactgatcctttcatctcctctcctgatatcgtcgatttcgagcctggatcggcccttcctctccacttcctacattggcgatttccacgcgcagatgcgtacgagatttcaccgcctggtcacgactatagcctgaggttgaagccttcaaagctgaatctgacatcatacgatggacaaaatgctacggaagatcagactttgttggccaggcgtcaagttgacacattatttacatttagtgttgatgtcacattttcgccacaacaacaagaggaagaagcgggagtaagcgtgtttctaacacagaaccatcacatcgaccttggcattgtgttgctacccttgcaaaatgactcagatacatctccaaccctgaagccccacttccgcttccgcgcgacaagctatgttgccgtgcctgatccggtagtggtgcctgtgcctgacgcctggctgaaccaatctttgaggctggaaattaaggcatccaacgtaacacattacgccttctctgccgggccgactgcacatcagtcgcagatgatgacagtggcctatggagccggaagtctggtcagttggggtttcactgggacgctagtcggcgtatatgctactactaacggcggaaacggcacaacagatgcatatgtgagccgatggaggtatcagggtcagggtcaatttattgattga

SEQ ID NO: 285 - protein, 576 aa, M. phaseolina
MELRTLLSPFFLFAAPLVLCSTGESSTYTNPILPGFHPDPSCILVAEWNHTTFCASSSFLAFPGIPIHASRDLLNWKLIGNALNRPEQLPELANTSRQTSGIWAPTIRYHKGTFYVVTTLVHDDRDAFDPQRWDNVIFSSKDPYDDAAWSDAVHFAFEGYDTSPFWDDDGQVYMTASHAYKVRPGIDQMTIDLETGETGEPVNLWNGTGGLAPEGPHVYKKDGLYYLMVAEGGTGLNHMQTIARSASVNGPYHAYQGNPILSNANTTEYFQTVGHADLFQDTAGSWWGVALATRSGPEFLTYPMGRETVLFPVTWTEGEWPVLSPVRGRMEGWPLPPPDHSIAGTDPFISSPDIVDFEPGSALPLHFLHWRFPRADAYEISPPGHDYSLRLKPSKLNLTSYDGQNATEDQTLLARRQVDTLFTFSVDVTFSPQQQEEEAGVSVFLTQNHHIDLGIVLLPLQNDSDTSPTLKPHFRFRATSYVAVPDPVVVPVPDAWLNQSLRLEIKASNVTHYAFSAGPTAHQSQMMTVAYGAGSLVSWGFTGTLVGVYATTNGGNGTTDAYVSRWRYQGQGQFID

SEQ ID NO: 286 - DNA, 2138 bp, M. phaseolina
cggatattcaatccacaggaacgacaacgacagcgaaggcgaccacagaccaagaagtgacgtcgtaaggggctcagacacccaatatataggcgtagaaccatccctcttcgctctccagcacctcattcttgcccattcatcaacatcatggtactctcgttcaagcttctcttttcttcacttgccacagtgaacgtggcactcagctcggctacacaaaatcagacacgctacaacccagccttacccggctggcacagcgatccaagctgcgttttcgtccctgagtgggacaacaccaccttctgcacttcttcgacattacgcctgacgcctggtctccccatttacgtcagccgagatctcacaaactggaaactgatcagccatgctttgtctcggaagagccagtatcctgagtacgaccaatccctggctcagtctgatggaatttgggcgccgacaatccgataccacaaggggactttctacatcatcaccatatacaacaaccaggcccttggaaaggcaaccggcttgattttcaagtcgaccgacccttacagcgactgcagttggagcgaccccattcgctatgatgccaagactattgatcccgacatcttctgggatgacgatggcaccgcatatgttgccactgccggcactaaccttcagactcttgataccgaaaccggtgttctcggtgaaccgcgcgtgatctggaacggcactaccggcatctatctcgaaggaccgcatctttacaagaaagacggctactactacctgctgaccgcagaaggcggctccggcctgaaccactcggtcaccatggcccgatcaacgaacatctggggcccatatgagagccacccacacaaccccgtcctcacaaaccgcaacacctccgcctacttccaaaacattggccacgccgacctcttccccgatgcgagcggcaactggtggtcatccgccctcgcctggcgctccggccccgccggccgcaactaccccatgggccgcgagatggtgcttaccaccgtgacctggccctccggcgcgtggcccaccttcgcgcccgtccgcggcgtgcaatctggctggcctctccctccctctccctccctccccggcgccgggccgctcacctccgcccccgacgccttcgacttcgcccccaacacatctctcccgcgcaacctcgcgacctggggctggcccgacccctccgcctacgccatctcgccccccggccacccgcacaccctgcgcctgaccccctcgcccgccagcatcacggacggccacgccaactacacggccggctacgacatcgccaaccgcacgctcctcctgcggcggcagacgcacacgctcttcgagttcagcatcgacctctccttcgccccgaccgccctcgacgaagaggccggcgtcaccgtcttcctcaacgacgtccagaacatcgcgctcggcgtcgtcatgctgcgcgacaacgcgaccgcgacgctcgcgccgcacctccgcctcctggcgtccggcatccagagcaacgccgccgacgacgacgacgccgtgcccgcgccggtcgtgctgcccatgcctcgcgcgtggcgcggcgatgcggtgcggctgagcgtgcgcgccgagaacgagacgcactacgcgttctacgcggcgggcagggcgcggccggcggacgcgcgggcggtggcctgggtgcccgcaaccgtggtgagcggcggcgtggggccgtttaccggtaagtggcctctttcgggctctccccctgtgtgttttctggacttgtgtgtgtggctgatgattccgctctaggctctctggtcggggtgtatgcgacgagcaatcatgggaacggcaccgcgccggcgtacatttccaggtggaggtaccacggtctcggtcaggcggttgggaatggagtcattgttccctctgacgcgactgagctctcttgatgtagacaggaggtaaggcgtccgtggtttctgatgtggtccgatgggaggaacagcactatttgcgggctccaggaggcggtggctcagaagaaagggacatgtacttgtttaaggggtaatacatgtgtcgtctgtggtttgggcctc

SEQ ID NO: 287 - DNA, 1764 bp, M. phaseolina
atggtactctcgttcaagcttctcttttcttcacttgccacagtgaacgtggcactcagctcggctacacaaaatcagacacgctacaacccagccttacccggctggcacagcgatccaagctgcgttttcgtccctgagtgggacaacaccaccttctgcacttcttcgacattacgcctgacgcctggtctccccatttacgtcagccgagatctcacaaactggaaactgatcagccatgctttgtctcggaagagccagtatcctgagtacgaccaatccctggctcagtctgatggaatttgggcgccgacaatccgataccacaaggggactttctacatcatcaccatatacaacaaccaggcccttggaaaggcaaccggcttgattttcaagtcgaccgacccttacagcgactgcagttggagcgaccccattcgctatgatgccaagactattgatcccgacatcttctgggatgacgatggcaccgcatatgttgccactgccggcactaaccttcagactcttgataccgaaaccggtgttctcggtgaaccgcgcgtgatctggaacggcactaccggcatctatctcgaaggaccgcatctttacaagaaagacggctactactacctgctgaccgcagaaggcggctccggcctgaaccactcggtcaccatggcccgatcaacgaacatctggggcccatatgagagccacccacacaaccccgtcctcacaaaccgcaacacctccgcctacttccaaaacattggccacgccgacctcttccccgatgcgagcggcaactggtggtcatccgccctcgcctggcgctccggccccgccggccgcaactaccccatgggccgcgagatggtgcttaccaccgtgacctggccctccggcgcgtggcccaccttcgcgcccgtccgcggcgtgcaatctggctggcctctccctccctctccctccctccccggcgccgggccgctcacctccgcccccgacgccttcgacttcgcccccaacacatctctcccgcgcaacctcgcgacctggggctggcccgacccctccgcctacgccatctcgccccccggccacccgcacaccctgcgcctgaccccctcgcccgccagcatcacggacggccacgccaactacacggccggctacgacatcgccaaccgcacgctcctcctgcggcggcagacgcacacgctcttcgagttcagcatcgacctctccttcgccccgaccgccctcgacgaagaggccggcgtcaccgtcttcctcaacgacgtccagaacatcgcgctcggcgtcgtcatgctgcgcgacaacgcgaccgcgacgctcgcgccgcacctccgcctcctggcgtccggcatccagagcaacgccgccgacgacgacgacgccgtgcccgcgccggtcgtgctgcccatgcctcgcgcgtggcgcggcgatgcggtgcggctgagcgtgcgcgccgagaacgagacgcactacgcgttctacgcggcgggcagggcgcggccggcggacgcgcgggcggtggcctgggtgcccgcaaccgtggtgagcggcggcgtggggccgtttaccggctctctggtcggggtgtatgcgacgagcaatcatgggaacggcaccgcgccggcgtacatttccaggtggaggtaccacggtctcggtcaggcggttgggaatggagtcattgttccctctgacgcgactgagctctcttga

SEQ ID NO: 288 - protein, 587 aa, M. phaseolina
MVLSFKLLFSSLATVNVALSSATQNQTRYNPALPGWHSDPSCVFVPEWDNTTFCTSSTLRLTPGLPIYVSRDLTNWKLISHALSRKSQYPEYDQSLAQSDGIWAPTIRYHKGTFYIITIYNNQALGKATGLIFKSTDPYSDCSWSDPIRYDAKTIDPDIFWDDDGTAYVATAGTNLQTLDTETGVLGEPRVIWNGTTGIYLEGPHLYKKDGYYYLLTAEGGSGLNHSVTMARSTNIWGPYESHPHNPVLTNRNTSAYFQNIGHADLFPDASGNWWSSALAWRSGPAGRNYPMGREMVLTTVTWPSGAWPTFAPVRGVQSGWPLPPSPSLPGAGPLTSAPDAFDFAPNTSLPRNLATWGWPDPSAYAISPPGHPHTLRLTPSPASITDGHANYTAGYDIANRTLLLRRQTHTLFEFSIDLSFAPTALDEEAGVTVFLNDVQNIALGVVMLRDNATATLAPHLRLLASGIQSNAADDDDAVPAPVVLPMPRAWRGDAVRLSVRAENETHYAFYAAGRARPADARAVAWVPATVVSGGVGPFTGSLVGVYATSNHGNGTAPAYISRWRYHGLGQAVGNGVIVPSDATELS

SEQ ID NO: 289 - DNA, 2195 bp, M. phaseolina
gatgcatgccgcaattggagcacacaaacgcgaaagtggggcaggaagtgaggggtcaatcatcaagctctactttgcccgaatccaaaaaccttaaaaccgcacgctgcaaccttgccaaagcacgacgcaaatcccaccgtctccaccatgggaatctacaacaaccctatcatccccggtttcaacccggacccgtcaatcgtacgggtggggcccgactacttccttgtcacctccacgtttgaatatttcccaggcgtcccaatttaccacagcaaagacctaatctactggaagctgataggccacgccctgacgcgccgctctcagctcgacatccgcacccccgagaccggcggcggtatctgggcgccgaccatccgatggcacgacggcgtcttctacgtcactacagcatgctttgacagatacagaccgcaagccgatgaccgcgtgtggccgcgcggcttctacgtcaaaacggccaatgtctgggacgagacgagctggtcggagccggtgtacttcgaccaggtggggtttgaccaggacgtgcgtgactcccctctctaagccgccatctccttttgcccctcaaagatcatataccaaagcaattgtaaatgcaaaaaaaaaaaaaaaaagatcagccaaaaacaaacggccaagactgtcacccaggcacactaacgcatcgaaccacagctcttctgggacaccgacggtacgacctacctctccaccacctaccgcaaatcgccgcgcacccccgtcccacccaactctccccccctcaaggattttgccatccacatctcgaccgtcgatctgcgcaccggcgccgcgacgtcgcctccgcgcctcgtccgcgcctcgtccgtcggcagcggcgtcgcggaggggtcgcatctgttcaagaggggggcgtggtactacctcttcacggccgagggcgggaccgagggcggccacagcgaggtcatgtcgaggagccacgagggcccgttcgggccatgggaggtgtgtccgcggggcccggtattgggcggagggcagggagaggtaaggcagacggggcatgcggatttggtggagggggtggacgggaggtggtgggcggtgtttttgggggtgaggagaagggcgggggaaacgggtggggattgggtggggagcgtgtttggtgagttgtctgcttttccttttctgggaggtgcggaagctgatcctgatgaaagggagagagacgtttcttgtaccagtgacgtgggagaacgattggccggtatttaatgcgggcaggagtgttgagcttctgggagaagcgccggggctgttccaggttgagcaaacggcagcgtggagagatgattttgaggcggaggagatgcagctgggatggtacaggaagagtaagagccaggagcaagctgacagtttgcattttttttttttttggctgatggacatcaacagatacaccggtgaagcaggacttctctttgacggagcgcccgggatatctgcgtctgtatggtggcccctacacactctctacgcctgcttgcccaaccctgttcctccgcaagcagagacacgatccggtgagatggaagacgcggctttcgttccatcccagctcgccaaacacagaagctgggtcccttgtatactggaatcagcatacgtactcgagcattggcatccggatggctcccgacggcagccaaggctgtgcaagaatactgcgatttcggcctgcgggagggaatgtggtggacatgccattgagatctacggagtcagatgttgtgctcgcaatcaagtcagacaacggatattcgtttgggtatagagaggtagtcggcgggacggatgacgaagaagtagtttggatcggccaagtgagcgctatggcgatgactcaggacccacaggttggcgcatcattcacagggatgatgtttggagtatttgcttttggagagatggaaaagtgctttaccccggcagacttcctgtatgccgagtttcagtcctaaagtgtagaattatgcggatctgctgggccggtaatcccaagacgaagcatcaatcaacttctggccgtcagcattttcgtcaaggaatagatggaaaatgttagacatataaggaatcctagccaaatgcgaagctggagcaatatccgt

SEQ ID NO: 290 - DNA, 1623 bp, M. phaseolina
atgggaatctacaacaaccctatcatccccggtttcaacccggacccgtcaatcgtacgggtggggcccgactacttccttgtcacctccacgtttgaatatttcccaggcgtcccaatttaccacagcaaagacctaatctactggaagctgataggccacgccctgacgcgccgctctcagctcgacatccgcacccccgagaccggcggcggtatctgggcgccgaccatccgatggcacgacggcgtcttctacgtcactacagcatgctttgacagatacagaccgcaagccgatgaccgcgtgtggccgcgcggcttctacgtcaaaacggccaatgtctgggacgagacgagctggtcggagccggtgtacttcgaccaggtggggtttgaccaggacctcttctgggacaccgacggtacgacctacctctccaccacctaccgcaaatcgccgcgcacccccgtcccacccaactctccccccctcaaggattttgccatccacatctcgaccgtcgatctgcgcaccggcgccgcgacgtcgcctccgcgcctcgtccgcgcctcgtccgtcggcagcggcgtcgcggaggggtcgcatctgttcaagaggggggcgtggtactacctcttcacggccgagggcgggaccgagggcggccacagcgaggtcatgtcgaggagccacgagggcccgttcgggccatgggaggtgtgtccgcggggcccggtattgggcggagggcagggagaggtaaggcagacggggcatgcggatttggtggagggggtggacgggaggtggtgggcggtgtttttgggggtgaggagaagggcgggggaaacgggtggggattgggtggggagcgtgtttgggagagagacgtttcttgtaccagtgacgtgggagaacgattggccggtatttaatgcgggcaggagtgttgagcttctgggagaagcgccggggctgttccaggttgagcaaacggcagcgtggagagatgattttgaggcggaggagatgcagctgggatggtacaggaagaatacaccggtgaagcaggacttctctttgacggagcgcccgggatatctgcgtctgtatggtggcccctacacactctctacgcctgcttgcccaaccctgttcctccgcaagcagagacacgatccggtgagatggaagacgcggctttcgttccatcccagctcgccaaacacagaagctgggtcccttgtatactggaatcagcatacgtactcgagcattggcatccggatggctcccgacggcagccaaggctgtgcaagaatactgcgatttcggcctgcgggagggaatgtggtggacatgccattgagatctacggagtcagatgttgtgctcgcaatcaagtcagacaacggatattcgtttgggtatagagaggtagtcggcgggacggatgacgaagaagtagtttggatcggccaagtgagcgctatggcgatgactcaggacccacaggttggcgcatcattcacagggatgatgtttggagtatttgcttttggagagatggaaaagtgctttaccccggcagacttcctgtatgccgagtttcagtcctaa

SEQ ID NO: 291 - protein, 540 aa, M. phaseolina
MGIYNNPIIPGFNPDPSIVRVGPDYFLVTSTFEYFPGVPIYHSKDLIYWKLIGHALTRRSQLDIRTPETGGGIWAPTIRWHDGVFYVTTACFDRYRPQADDRVWPRGFYVKTANVWDETSWSEPVYFDQVGFDQDLFWDTDGTTYLSTTYRKSPRTPVPPNSPPLKDFAIHISTVDLRTGAATSPPRLVRASSVGSGVAEGSHLFKRGAWYYLFTAEGGTEGGHSEVMSRSHEGPFGPWEVCPRGPVLGGGQGEVRQTGHADLVEGVDGRWWAVFLGVRRRAGETGGDWVGSVFGRETFLVPVTWENDWPVFNAGRSVELLGEAPGLFQVEQTAAWRDDFEAEEMQLGWYRKNTPVKQDFSLTERPGYLRLYGGPYTLSTPACPTLFLRKQRHDPVRWKTRLSFHPSSPNTEAGSLVYWNQHTYSSIGIRMAPDGSQGCARILRFRPAGGNVVDMPLRSTESDVVLAIKSDNGYSFGYREVVGGTDDEEVVWIGQVSAMAMTQDPQVGASFTGMMFGVFAFGEMEKCFTPADFLYAEFQS

SEQ ID NO: 292 - DNA, 1517 bp, M. phaseolina
gtaactagaaagctaaatgcaggtaacctttctgtacacttcattgccagtaatcgatataaattctgtgcagcgcgtttctttggcaagcaatcctttcgagggacgaaccactcattcgttcattcattccatcgcttgcgcccggcaatgctgaagctggtatttctcgttcttgcccttctgcacacggcagcatgggcacagtcaacctatcctcccccgatgcagtgccgaggcggttgtaccaacgtgcacgatggctcgttgattcagcgtgacgatgggaaatggttccgcttcgctggttcctggggcatgtccatcttcacttccgatgacttcctcggtccctgggattctgtgggaactgcattagacaacaataccgacagatgggtatagctgctcccttttcttttccattgtcgccaccatcccggtacaatgcaaagaaaatccaagaaagacgaaaaacataaactatcccttctccgcacctccaccccaccctccacctcctcgctaaaatatacacccgcgataggcgcccgacgtccacaaagtcggcaatctctactatctctactactccatcagcacctggggcacgcagaactctcacatcggcgtcgccacctcgccctcgctcgagccgggcacgtggaccgacctgggcagcacgggcgtcgcatcgcgcgacggctcgcgctacaacgccatcgacggcaacctcttccaggacggcgacggcagcttcctgctcaccttcggatccttctggggcaacacctaccaagtaccgctgacgtcgcccgagcccacccgcgcgaacggcaatccgtacaacatccagttcaactcgaccggcagccaatcgtccgaggggccgtatctgttcaagtttggcgaatggtattatctattctggtcgagcgggcagtgctgcaagtacgatacggagcgcccgaggcagggcgaggagtacaagattatggtgtgtcgggcggagcgcgcgagcgggccgtttgtaggttttttttttttttccacttcccctgttaaaactttttttgtggcgtatccgcggaaggaacttaggactttggagcggcatggctgaagtttccctgaaacaggtcgacatggacaatacgccttgcacgcagaacggcgggacgcaggtgctcggcagccacgatttcgtgtacgggccgggcgggcaggggctttaccacattccgaactatggcccggtgatatattatcattatgttgataccaaggtcgggttcgcggatgggcagaagcggattgggattaacaaggtggattttgtgacggggtggccggtgttggtgggctaatgaggcggctttgcccatttcgtttgtcccttttcccaccagtactactgacttctttgtccagtgctctgtaacattcctgaagtatagctatttcagcgacgattcctaacagtagactgtcctttggacgcatggagttcagggata

SEQ ID NO: 293 - DNA, 960 bp, M. phaseolina
atgctgaagctggtatttctcgttcttgcccttctgcacacggcagcatgggcacagtcaacctatcctcccccgatgcagtgccgaggcggttgtaccaacgtgcacgatggctcgttgattcagcgtgacgatgggaaatggttccgcttcgctggttcctggggcatgtccatcttcacttccgatgacttcctcggtccctgggattctgtgggaactgcattagacaacaataccgacagatgggcgcccgacgtccacaaagtcggcaatctctactatctctactactccatcagcacctggggcacgcagaactctcacatcggcgtcgccacctcgccctcgctcgagccgggcacgtggaccgacctgggcagcacgggcgtcgcatcgcgcgacggctcgcgctacaacgccatcgacggcaacctcttccaggacggcgacggcagcttcctgctcaccttcggatccttctggggcaacacctaccaagtaccgctgacgtcgcccgagcccacccgcgcgaacggcaatccgtacaacatccagttcaactcgaccggcagccaatcgtccgaggggccgtatctgttcaagtttggcgaatggtattatctattctggtcgagcgggcagtgctgcaagtacgatacggagcgcccgaggcagggcgaggagtacaagattatggtgtgtcgggcggagcgcgcgagcgggccgtttgtcgacatggacaatacgccttgcacgcagaacggcgggacgcaggtgctcggcagccacgatttcgtgtacgggccgggcgggcaggggctttaccacattccgaactatggcccggtgatatattatcattatgttgataccaaggtcgggttcgcggatgggcagaagcggattgggattaacaaggtggattttgtgacggggtggccggtgttggtgggctaa

SEQ ID NO: 294 - protein, 319 aa, M. phaseolina
MLKLVFLVLALLHTAAWAQSTYPPPMQCRGGCTNVHDGSLIQRDDGKWFRFAGSWGMSIFTSDDFLGPWDSVGTALDNNTDRWAPDVHKVGNLYYLYYSISTWGTQNSHIGVATSPSLEPGTWTDLGSTGVASRDGSRYNAIDGNLFQDGDGSFLLTFGSFWGNTYQVPLTSPEPTRANGNPYNIQFNSTGSQSSEGPYLFKFGEWYYLFWSSGQCCKYDTERPRQGEEYKIMVCRAERASGPFVDMDNTPCTQNGGTQVLGSHDFVYGPGGQGLYHIPNYGPVIYYHYVDTKVGFADGQKRIGINKVDFVTGWPVLVG

SEQ ID NO: 295 - DNA, 1578 bp, M. phaseolina
ccttataagctgctgctgtcctccgtgatcatgtctctcattccagagccccatctccacactcccttgcgctccgcgtatatatctcccttcccttcttgactcataaatttgtttgccagccatccgcgcattgcatatatccccacgatgctgtcctccctggccgccctcggtgcaaccgcactgctgtctatagccccactggtcaaggcccttccccttgagaagcgggttgtaaatggtcctgtcatttcttccaacttccccgacccttccatcattcgcgtcggcaacacttggtactccttcggcacaaacagcgcagacaacggcggcgtgcatgtccagattgccaaatctgacgatttcagctcatggaccgtgttgggcaaggatgcacttccgaacttgcccggatgggtttacactgcaaaccccgccgtctgggctcccgatgtcatccagaacgtatgcatgctcacatcatccctgcacccggaagaggaagcactgctgacacagctgccttttcaggatgcgggcaaatttgtgctttacttttctgcctctcgcaacgacaagctgcactgcactggtgtcgctattgctgacaccatcgagggtccctacactgcccgccctgacccctgggcttgtcctctcgaccaaggcggcgccattgacgcctcaagcttccgcgactcggatggcacccgctacgtgacttacaaaattgatgtaagcgctccggcatgatctcacttcagcctcggccctcattcgcgcgaatcaaaattcatgctgactgaatttcccaacagggcaatgccctcggcggcggtggtgtttgcggcaacactgagcccccgatcaggtcaactcccatcatgcagcaaaaggtcgccggcaacggtattgacaagatcggtgacgcttaccaagtattggaccgctcagacgcagacggcccgctggttgaagcccccagcatcgcgaagctgcccaacggtcattatgtgttatttttcagctcaaactgcttctacacgatcgactacgacgtgacatacgccattgcacccagtaagtacccacacagcccacttctttctctttcaaatatcggcactatccggtctgtaccgtccggcacggtacgatcggatccacgttggcggcctgatgatcaaagacttacacgcgcattcattaaccatggcaggcgtctccggcccttataccaagtccggcccgctgtttgtctcgcagggcaagcacggtttctggtcgcccggtggagccagcatctcgcccgacgcgaagcacctcgtcttccattcctacaaccccggcggttccaacacccgcgccatgtacacgtcaaccctcacctggcacggcgacgtcccgaactcggaggcataagctgaagagcggagcaagagaacataaagaccatcacgcctctttacgaattttctttctgcattgtccattcgacatcgtcaagccggcgatcatccgttcaagactacgtacagaagcagtgcagatgcactgcttcggccccgcttt

SEQ ID NO: 296 - DNA, 1056 bp, M. phaseolina
atgctgtcctccctggccgccctcggtgcaaccgcactgctgtctatagccccactggtcaaggcccttccccttgagaagcgggttgtaaatggtcctgtcatttcttccaacttccccgacccttccatcattcgcgtcggcaacacttggtactccttcggcacaaacagcgcagacaacggcggcgtgcatgtccagattgccaaatctgacgatttcagctcatggaccgtgttgggcaaggatgcacttccgaacttgcccggatgggtttacactgcaaaccccgccgtctgggctcccgatgtcatccagaacgtatgcatgctcacatcatccctgcacccggaagaggaagcactgctgacacagctgccttttcaggatgcgggcaaatttgtgctttacttttctgcctctcgcaacgacaagctgcactgcactggtgtcgctattgctgacaccatcgagggtccctacactgcccgccctgacccctgggcttgtcctctcgaccaaggcggcgccattgacgcctcaagcttccgcgactcggatggcacccgctacgtgacttacaaaattgatggcaatgccctcggcggcggtggtgtttgcggcaacactgagcccccgatcaggtcaactcccatcatgcagcaaaaggtcgccggcaacggtattgacaagatcggtgacgcttaccaagtattggaccgctcagacgcagacggcccgctggttgaagcccccagcatcgcgaagctgcccaacggtcattatgtgttatttttcagctcaaactgcttctacacgatcgactacgacgtgacatacgccattgcacccagcgtctccggcccttataccaagtccggcccgctgtttgtctcgcagggcaagcacggtttctggtcgcccggtggagccagcatctcgcccgacgcgaagcacctcgtcttccattcctacaaccccggcggttccaacacccgcgccatgtacacgtcaaccctcacctggcacggcgacgtcccgaactcggaggcataa

SEQ ID NO: 297 - protein, 351 aa, M. phaseolina
MLSSLAALGATALLSIAPLVKALPLEKRVVNGPVISSNFPDPSIIRVGNTWYSFGTNSADNGGVHVQIAKSDDFSSWTVLGKDALPNLPGWVYTANPAVWAPDVIQNVCMLTSSLHPEEEALLTQLPFQDAGKFVLYFSASRNDKLHCTGVAIADTIEGPYTARPDPWACPLDQGGAIDASSFRDSDGTRYVTYKIDGNALGGGGVCGNTEPPIRSTPIMQQKVAGNGIDKIGDAYQVLDRSDADGPLVEAPSIAKLPNGHYVLFFSSNCFYTIDYDVTYAIAPSVSGPYTKSGPLFVSQGKHGFWSPGGASISPDAKHLVFHSYNPGGSNTRAMYTSTLTWHGDVPNSEA

SEQ ID NO: 298 - DNA, 1442 bp, M. phaseolina
tttcaagccagtaccatggcgcatcgttacaagtcaggcgtatcctcaaactggatctatcttgtctatatatgccgtatcaatgtcgaaaaggccttttgagaaagtccacgccgcttctacttcgacttcgtgcatccagccccagcgatgctgtgctacccctgcgcgctgctatcaatagccacggcggttgctgccagctcaacccccaagcttgcgctcaactcggtcatcaggtccgattttccggatccctcactcctccaggatggtgatatgtggtattcttttggcaccaaccaaaaccgggatatccatgtgcagatcgccacatcgtccgactttgatacctgggcggtgatttctggcacggacgcactcccaaacttgcctggatgggtgaatccgctcgacccggccgtatgggcacctgatgtaataaagaacgtacgcctcctccgaataaccccgtgtggaacctggtcgctactgacatttctgcctggaggacgatggcaaatacgtgctttactttagcgccgccaagatcgatgctgccaggcattgcataggagtagcgacgtccgacaatgttgaaggcccgtacactgctcaagacgagccgtgggtttgtcatctggagcagggcggcgctatcgatgcttcaagcttccgggactccgacgggtctcgctacgtcacatataagatcgacgtgcgtgaatggtttcgggcttttcttcagtcggcgttttcttttttttgagctgaccagatggcagggaaactcgctcaatacccgtgatggctcttgcggcggggcacggccatacaatccaaccccgatcatgcagcagcaagttagcgccaatggtatcgacaagattggcgatccgatcgtgcttctggatcgtgaggagcctgacgggcccctcatcgaagcccccagcatcgcgaagctccctgacgggcgctacgtcttgtttttcagctccaactgctggcaatttgactacgatttgagttacgcgcttgcggacagtgagtagcactccgcacatgttggacacaaatcatgagctgaactcattgcgacaggcgtgaggggtccgtatacaaagtcggggccactgttcactagcacgggaagcggtttggacaaccctggaggtgcgagcatagccgccgatggtatccacctggtctttcatgccttcgtcgccgaaaagacccgcggcgtatattctacctcggttgctttcaatggcgacgaggtaacgacaggctaaggagagcgctcattgcggtgtacgtttggtatgggtgtggggttgattccgcgcatagcgcggttgccgcgattctgaaattgtgtgttacatcttcaatgtaaatacaactttgctcaacctcattttcacggttccgtttattgttgg

SEQ ID NO: 299 - DNA, 957 bp, M. phaseolina
atgctgtgctacccctgcgcgctgctatcaatagccacggcggttgctgccagctcaacccccaagcttgcgctcaactcggtcatcaggtccgattttccggatccctcactcctccaggatggtgatatgtggtattcttttggcaccaaccaaaaccgggatatccatgtgcagatcgccacatcgtccgactttgatacctgggcggtgatttctggcacggacgcactcccaaacttgcctggatgggtgaatccgctcgacccggccgtatgggcacctgatgtaataaagaacgacgatggcaaatacgtgctttactttagcgccgccaagatcgatgctgccaggcattgcataggagtagcgacgtccgacaatgttgaaggcccgtacactgctcaagacgagccgtgggtttgtcatctggagcagggcggcgctatcgatgcttcaagcttccgggactccgacgggtctcgctacgtcacatataagatcgacggaaactcgctcaatacccgtgatggctcttgcggcggggcacggccatacaatccaaccccgatcatgcagcagcaagttagcgccaatggtatcgacaagattggcgatccgatcgtgcttctggatcgtgaggagcctgacgggcccctcatcgaagcccccagcatcgcgaagctccctgacgggcgctacgtcttgtttttcagctccaactgctggcaatttgactacgatttgagttacgcgcttgcggacagcgtgaggggtccgtatacaaagtcggggccactgttcactagcacgggaagcggtttggacaaccctggaggtgcgagcatagccgccgatggtatccacctggtctttcatgccttcgtcgccgaaaagacccgcggcgtatattctacctcggttgctttcaatggcgacgaggtaacgacaggctaa

SEQ ID NO: 300 - protein, 318 aa, M. phaseolina
MLCYPCALLSIATAVAASSTPKLALNSVIRSDFPDPSLLQDGDMWYSFGTNQNRDIHVQIATSSDFDTWAVISGTDALPNLPGWVNPLDPAVWAPDVIKNDDGKYVLYFSAAKIDAARHCIGVATSDNVEGPYTAQDEPWVCHLEQGGAIDASSFRDSDGSRYVTYKIDGNSLNTRDGSCGGARPYNPTPIMQQQVSANGIDKIGDPIVLLDREEPDGPLIEAPSIAKLPDGRYVLFFSSNCWQFDYDLSYALADSVRGPYTKSGPLFTSTGSGLDNPGGASIAADGIHLVFHAFVAEKTRGVYSTSVAFNGDEVTTG

SEQ ID NO: 301 - DNA, 1410 bp, M. phaseolina
tcgagaagccttcgagcaggtttctaagccttcgaccataagtacagcacttcccggagcaccagaccggtcatcacagcccaacagcttccaactgcccaacaaagcctccccaagccacactacaggctcagtcattcgtttccaatgatgttctacactcgtttcgccgcggcggccctgctgtccgcctccgccctcaccgaggcggctcctaccaacatgaccgccggcggcttcaagccaccgcacttcaagacccaacgggtcgtcgacaccgaattcgccgacccgggcatcctcaaggtcggcgacacctggtacgccttcgcgaccaacaacggcaaatccaacgtccgcgttgccacctcgaccgacttcgaacactggaccgtcaaggagaagtgggacgcgctgccgctcaccggcgcgtggaccgcgcagcccaagatgcagacggagaagctgctgcccacgtccgacaagttcctcgacagcgtcggcgggctcctcgagggccggtggccgtggtccaacgcgccgcccgccgtctgggcgcccgacgccgtgaccaacgacgacggcatgcacgtgctctactactcggcgcagcagcgcggccagaagcggcactgcatcggcgcggccgtgggagccacgcccgaggggccctaccgcgcgttcgacgagccgttcgcgtgccacgaggagcagggcggcagcatcgacccctcgggcttcagggacacggcgaccggcaagcgctacgtcgtgtacaagatcgacggcaacaacaacggcaacggcgggctgtgcggcaacatggtcgcgccgcaggtgcccacgcccatcatgctgcaggaagtcggcccggacggctacaccaagatcggcgagcccaagcagatcctcgacaggggcgaggccgacggcccgctggtcgaggctccgaatctcgtcaggaccgaggacggccggtacgtgctgttcttcagctcgaactgctactccaccgaaatgtacgacattggctacgccttcgcggacagcgtcgagggcccctacaccaaggccggcccgtttgcggtgacgggcactgcgggactgaaggcgcccggcggcgctacggttgccgaggatgggaagcacatggtcttccacgccgcggatagcaagggtggccggtccatgtacacgactgaggtgtcgttcgcgctcggcccggataggaagatgagggttgcggcgaaggcggcttaatgttgtcccgcattctggcaatgcacttggagagctggaatgtttatgacatgttggttcacgcctgggtttacgctattgaggatatggctgtgaagtccctctaatgtataaagcataatagatttttgttgaagacttgcaagttga

SEQ ID NO: 302 - DNA, 1110 bp, M. phaseolina
atgttctacactcgtttcgccgcggcggccctgctgtccgcctccgccctcaccgaggcggctcctaccaacatgaccgccggcggcttcaagccaccgcacttcaagacccaacgggtcgtcgacaccgaattcgccgacccgggcatcctcaaggtcggcgacacctggtacgccttcgcgaccaacaacggcaaatccaacgtccgcgttgccacctcgaccgacttcgaacactggaccgtcaaggagaagtgggacgcgctgccgctcaccggcgcgtggaccgcgcagcccaagatgcagacggagaagctgctgcccacgtccgacaagttcctcgacagcgtcggcgggctcctcgagggccggtggccgtggtccaacgcgccgcccgccgtctgggcgcccgacgccgtgaccaacgacgacggcatgcacgtgctctactactcggcgcagcagcgcggccagaagcggcactgcatcggcgcggccgtgggagccacgcccgaggggccctaccgcgcgttcgacgagccgttcgcgtgccacgaggagcagggcggcagcatcgacccctcgggcttcagggacacggcgaccggcaagcgctacgtcgtgtacaagatcgacggcaacaacaacggcaacggcgggctgtgcggcaacatggtcgcgccgcaggtgcccacgcccatcatgctgcaggaagtcggcccggacggctacaccaagatcggcgagcccaagcagatcctcgacaggggcgaggccgacggcccgctggtcgaggctccgaatctcgtcaggaccgaggacggccggtacgtgctgttcttcagctcgaactgctactccaccgaaatgtacgacattggctacgccttcgcggacagcgtcgagggcccctacaccaaggccggcccgtttgcggtgacgggcactgcgggactgaaggcgcccggcggcgctacggttgccgaggatgggaagcacatggtcttccacgccgcggatagcaagggtggccggtccatgtacacgactgaggtgtcgttcgcgctcggcccggataggaagatgagggttgcggcgaaggcggcttaa

SEQ ID NO: 303 - protein, 369 aa, M. phaseolina
MFYTRFAAAALLSASALTEAAPTNMTAGGFKPPHFKTQRVVDTEFADPGILKVGDTWYAFATNNGKSNVRVATSTDFEHWTVKEKWDALPLTGAWTAQPKMQTEKLLPTSDKFLDSVGGLLEGRWPWSNAPPAVWAPDAVTNDDGMHVLYYSAQQRGQKRHCIGAAVGATPEGPYRAFDEPFACHEEQGGSIDPSGFRDTATGKRYVVYKIDGNNNGNGGLCGNMVAPQVPTPIMLQEVGPDGYTKIGEPKQILDRGEADGPLVEAPNLVRTEDGRYVLFFSSNCYSTEMYDIGYAFADSVEGPYTKAGPFAVTGTAGLKAPGGATVAEDGKHMVFHAADSKGGRSMYTTEVSFALGPDRKMRVAAKAA

SEQ ID NO: 304 - DNA, 1399 bp, M. phaseolina
ccatagtgcatgtccgcggccgctgaagtcatcagtataaatgctgctcgacttgctcgcatctagtgctatcaaccactgaacctcatctgccatttgaaaagccggcctttcgtcctgtaccaacacttctttctctcattcaccaaaatgcacggctctaccgctctttcacttctcattgccttcccagccgccttcggcgccgtcctccctcgccaggctgcggagagcatcaacgaaaagttcgttgcaaagggcaagaagtacttcggtacttgcgccgaccagggcaccctcaccagcggatcaaatgcggcaatcatcaaggccgacttcgggcaggtcacgcctgagaacagcatgaaatgggatgcagtcgagccatcccagggcaactttaacttcgctggggcggactacctggttgactttgccactaccaacaacaagctcatccgcggacacactacggtgtggcattcgcagctgccttcctgggtgagcagcatcacggacaagtccaccttgacgaaggtcatccaggaccacgtctccaaggagatcggaagatacaagggcaaaatctatgcctgggtgcgtctcaatctcaaacatcttcccggccagctggtggagaacgcgcttactgacaagcccatctcaggacgtggtgaacgagatcttcaacgaagacggcaccctcaggtcctccgttttctacaacgtcctcggcgaagacttcgtccgcattgccttcgaagctgcccgcgccgccgacccgaacgctaagctgtacatcaacgactacaagtacgtcttgcatctaatcattttcggacacgtgcgctgacccctcattccttctagcctcgacagcgccacgtacgccaagacgaccggcttgatcagcaaagtcaagcagtggatcgccgccggcgttcccatcgacggcatcggctcgcagtcgcacctgtccgccggcggcgcctccggcacgggcgccgcgatgaaggcgctgtgcgctgcggcctccgagtgcgccatcaccgagcttgacatcgcgggtgcggcggcgagcgactacgtgactgctacgaaggcttgcctggatgtcgagaactgcgtcggtatcacggtctggggcgtcagcgatgccaacagctggagggccagctcgtctccgctgctgttcgatgcgtcgtaccagccgaaggcggcgtacacggctatcatcaatgccttgtagggaggatgaggagtgtagatggtttcggttcttgtatgtatagaagagcgatgagctggtaaatagctgatcgttctcttttgatcatcgcccttatctgtgtagcactatagaaatatataaatatatatatatatatatatatcacgc

SEQ ID NO: 305 - DNA, 972 bp, M. phaseolina
atgcacggctctaccgctctttcacttctcattgccttcccagccgccttcggcgccgtcctccctcgccaggctgcggagagcatcaacgaaaagttcgttgcaaagggcaagaagtacttcggtacttgcgccgaccagggcaccctcaccagcggatcaaatgcggcaatcatcaaggccgacttcgggcaggtcacgcctgagaacagcatgaaatgggatgcagtcgagccatcccagggcaactttaacttcgctggggcggactacctggttgactttgccactaccaacaacaagctcatccgcggacacactacggtgtggcattcgcagctgccttcctgggtgagcagcatcacggacaagtccaccttgacgaaggtcatccaggaccacgtctccaaggagatcggaagatacaagggcaaaatctatgcctgggacgtggtgaacgagatcttcaacgaagacggcaccctcaggtcctccgttttctacaacgtcctcggcgaagacttcgtccgcattgccttcgaagctgcccgcgccgccgacccgaacgctaagctgtacatcaacgactacaacctcgacagcgccacgtacgccaagacgaccggcttgatcagcaaagtcaagcagtggatcgccgccggcgttcccatcgacggcatcggctcgcagtcgcacctgtccgccggcggcgcctccggcacgggcgccgcgatgaaggcgctgtgcgctgcggcctccgagtgcgccatcaccgagcttgacatcgcgggtgcggcggcgagcgactacgtgactgctacgaaggcttgcctggatgtcgagaactgcgtcggtatcacggtctggggcgtcagcgatgccaacagctggagggccagctcgtctccgctgctgttcgatgcgtcgtaccagccgaaggcggcgtacacggctatcatcaatgccttgtag

SEQ ID NO: 306 - protein, 323 aa, M. phaseolina
MHGSTALSLLIAFPAAFGAVLPRQAAESINEKFVAKGKKYFGTCADQGTLTSGSNAAIIKADFGQVTPENSMKWDAVEPSQGNFNFAGADYLVDFATTNNKLIRGHTTVWHSQLPSWVSSITDKSTLTKVIQDHVSKEIGRYKGKIYAWDVVNEIFNEDGTLRSSVFYNVLGEDFVRIAFEAARAADPNAKLYINDYNLDSATYAKTTGLISKVKQWIAAGVPIDGIGSQSHLSAGGASGTGAAMKALCAAASECAITELDIAGAAASDYVTATKACLDVENCVGITVWGVSDANSWRASSSPLLFDASYQPKAAYTAIINAL

SEQ ID NO: 307 - DNA, 1556 bp, M. phaseolina
ttggggccaatgcggaggacaaggctggagcggtgacagcagctgcgtatctggctacacttgtgtgactgtaaaccaatggtactctcaggtgattattttcctcaacgccacaccctggggcttgcgttaacactccatgctccgcagatgtgccagcaagggtccgcacccccagctaccaccctggtctcctccaccacggcagccaccagcgccaccgcgcccgcctccaccgcaaccggcggcctggacgcacgcttcaaggctcgaggcaagaagtattatggggttgccacggaccagggacgcctcacggccggccaaaacgcagcaatcatccaggccgacttcggccaagtcacgcctgagaatagcatgaagtgggatacaatcgagccgtcgcgcggctcctttaactttgcccaagccgactacctcgtcaactgggcaaccaccaacaataagctgatccgcggtcataccactgtctggcactcgcagctgccgaactgggttagcagcatcactgacaaggccaccttgaccaccgtgatgcagaaccacatcgccaccgagattgggaggtataagggcaagatctatgcctgggtaagtgcttggtcatgaaatattgttctggatcgtctgatccgtccaccgtgtggctggggtcattgtcgccctctgcgttgctccctcaaccgatcacacatatgtcagcaagaagcgcaacaaaccatgctgacgccctccccaggacgttgtcaatgaaatatttaacgaagacggctctttccgctcctcggtcttctacaacgtccttggccaggacttcgtccgccttgccttcgaggccgcccgcgccgccgaccccaacgccaagctctacatcaacgactacaagtgagttcccccgttcatctacctcctcgccaaccccccatcccccttccgcacatacatacatacatacatacacacacacacaacaagactaacgcatgcccctcgcaaaaacccccagcctcgacagcgccacctacgccaaaacaaccggcctcatttccaaagtcaaagcctggatcgcggccggcgtccccatcgacggcattggctcgcagtctcacctgtcggcgggccaagcgtccggcaccggcgccgccatgaaggccctctgcgccgccgcgcccgagtgcgccatcaccgagctcgacatcgtcaacgccgcacccgccgactacgtcgccgtcaccaaggcctgcctcgacgtcgccaactgcgtgggcattacggtctggggcttgcgcgacccggatagctggagggccagtaacaaccccctgctgtttgatgcgaattatcagcctaagccggcgtacacggcggtgttgaactcgctgtaggcggggcgtgtgtgtggtttttctgcgggcgagggagcagaggaggagtgcgtagcacgttctatgtaggtattttttttttttttccttggaacacgtacatatatgacaacgggatgagggagagaagaaaaggtgggatatcgccgc

SEQ ID NO: 308 - DNA, 987 bp, M. phaseolina
atgtgccagcaagggtccgcacccccagctaccaccctggtctcctccaccacggcagccaccagcgccaccgcgcccgcctccaccgcaaccggcggcctggacgcacgcttcaaggctcgaggcaagaagtattatggggttgccacggaccagggacgcctcacggccggccaaaacgcagcaatcatccaggccgacttcggccaagtcacgcctgagaatagcatgaagtgggatacaatcgagccgtcgcgcggctcctttaactttgcccaagccgactacctcgtcaactgggcaaccaccaacaataagctgatccgcggtcataccactgtctggcactcgcagctgccgaactgggttagcagcatcactgacaaggccaccttgaccaccgtgatgcagaaccacatcgccaccgagattgggaggtataagggcaagatctatgcctgggacgttgtcaatgaaatatttaacgaagacggctctttccgctcctcggtcttctacaacgtccttggccaggacttcgtccgccttgccttcgaggccgcccgcgccgccgaccccaacgccaagctctacatcaacgactacaacctcgacagcgccacctacgccaaaacaaccggcctcatttccaaagtcaaagcctggatcgcggccggcgtccccatcgacggcattggctcgcagtctcacctgtcggcgggccaagcgtccggcaccggcgccgccatgaaggccctctgcgccgccgcgcccgagtgcgccatcaccgagctcgacatcgtcaacgccgcacccgccgactacgtcgccgtcaccaaggcctgcctcgacgtcgccaactgcgtgggcattacggtctggggcttgcgcgacccggatagctggagggccagtaacaaccccctgctgtttgatgcgaattatcagcctaagccggcgtacacggcggtgttgaactcgctgtag

SEQ ID NO: 309 - protein, 328 aa, M. phaseolina
MCQQGSAPPATTLVSSTTAATSATAPASTATGGLDARFKARGKKYYGVATDQGRLTAGQNAAIIQADFGQVTPENSMKWDTIEPSRGSFNFAQADYLVNWATTNNKLIRGHTTVWHSQLPNWVSSITDKATLTTVMQNHIATEIGRYKGKIYAWDVVNEIFNEDGSFRSSVFYNVLGQDFVRLAFEAARAADPNAKLYINDYNLDSATYAKTTGLISKVKAWIAAGVPIDGIGSQSHLSAGQASGTGAAMKALCAAAPECAITELDIVNAAPADYVAVTKACLDVANCVGITVWGLRDPDSWRASNNPLLFDANYQPKPAYTAVLNSL

SEQ ID NO: 310 - DNA, 1761 bp, M. phaseolina
gcggaactccggctcgacgcgctctccccccacattgcgtccaggagtatatatgtgcttcatgctctccgtccaagagtgtttcgttccttaccgcctgccgtagtagctgcttctctctttctccagacttgaggtcactctttcgccatgtcattccttgctactactttcacttctcttctcgccgtccaggccgctcaagccatcccattctcgtgagcttctccacatcatttccgcacttgccattgctgacttcaccggcgtagtcgccgtgctgcagctggtctgaacacggctgcgcaagctgccggccttgagtacttcggttctgccactgacaaccccgaactcaccgacactgcctatgtcgccggcttgaacaacaccgccgacttcggccagattactcccggcaactcgcagaagtgggacaccatcgaggcctcgcgcaacactttctcctacaccaagggagatgtgattgctgaccttgctgaggctaacggccagaagctgcgctgccacacccttgtctggtacaaccagctgcccaactgggtcaagagcggtggattcgacaacgccacgctggtcgagattctacagaaccacatcaagaacgaggtcacccactacaagggccgttgtgcgcactgggatgtcgtcaacgaggccctcaacgaggatggcacttaccgcgatatggtcttctacaacaccattggcgaggcttacattcccattgccttcgctgccgctgccgcggccgaccccgaagccaagctctactacaacgactacaacattgagtggtccggcgacaagcagaaggctgccaagaagatcgtccagatgattcagtcctatggcgtcaagatcgatggcgttggtcttcaggctcacttcactgtcggcaacaccgcctcccaggatgccattgaaggcgtgatcaaggacttcgcctcccttggcgttgaagtcgccatcactgagctcgacatccgtatggagacccccgcaaccgatgcaaacctcaagcagcaggccaccgactaccagaccgtcgtcaatgcttgtttgaatcagaaagacgcctgcaagggtattaccatttgggactacacggacaagtactcttgggtgtgagtaataaccgatctccatttattcttctcaactcacccgtaattacacaggccttccaccttctccggatacggcgctgcccttccttgggatgagaacttggagaagaagcctgcctacgatgccatcctgtccgccctcgaggcggcggctggcgccaacagcagcagtacgtctgtccctgcggccaacaccaccaccccggccgccaccgcccccaccgctactgccactaagacttcgggcagcgcagtagccgcccaatcggcgacttctgtccaggtagcggagacccccgctactacaccggccgcttctactccgacttctggttccaccgctggcgccgctgtggccagatatggccagtgcggaggtgtgaactactccggctcgacaacctgcgagagcggctccacctgcaaggagtggaattcgtattatcatcaatgcgtgtaattaggcttcgtgagaaaggcttgatgctgagaacgagtgttgtcgtttgccccttcattgtcgatacttttcagacagacatactatactttacttcttcaaatacttcaaagctcaccataccctctacaaactcttgacagctagctg

SEQ ID NO: 311 - DNA, 1353 bp, M. phaseolina
atgtcattccttgctactactttcacttctcttctcgccgtccaggccgctcaagccatcccattctctcgccgtgctgcagctggtctgaacacggctgcgcaagctgccggccttgagtacttcggttctgccactgacaaccccgaactcaccgacactgcctatgtcgccggcttgaacaacaccgccgacttcggccagattactcccggcaactcgcagaagtgggacaccatcgaggcctcgcgcaacactttctcctacaccaagggagatgtgattgctgaccttgctgaggctaacggccagaagctgcgctgccacacccttgtctggtacaaccagctgcccaactgggtcaagagcggtggattcgacaacgccacgctggtcgagattctacagaaccacatcaagaacgaggtcacccactacaagggccgttgtgcgcactgggatgtcgtcaacgaggccctcaacgaggatggcacttaccgcgatatggtcttctacaacaccattggcgaggcttacattcccattgccttcgctgccgctgccgcggccgaccccgaagccaagctctactacaacgactacaacattgagtggtccggcgacaagcagaaggctgccaagaagatcgtccagatgattcagtcctatggcgtcaagatcgatggcgttggtcttcaggctcacttcactgtcggcaacaccgcctcccaggatgccattgaaggcgtgatcaaggacttcgcctcccttggcgttgaagtcgccatcactgagctcgacatccgtatggagacccccgcaaccgatgcaaacctcaagcagcaggccaccgactaccagaccgtcgtcaatgcttgtttgaatcagaaagacgcctgcaagggtattaccatttgggactacacggacaagtactcttgggtgccttccaccttctccggatacggcgctgcccttccttgggatgagaacttggagaagaagcctgcctacgatgccatcctgtccgccctcgaggcggcggctggcgccaacagcagcagtacgtctgtccctgcggccaacaccaccaccccggccgccaccgcccccaccgctactgccactaagacttcgggcagcgcagtagccgcccaatcggcgacttctgtccaggtagcggagacccccgctactacaccggccgcttctactccgacttctggttccaccgctggcgccgctgtggccagatatggccagtgcggaggtgtgaactactccggctcgacaacctgcgagagcggctccacctgcaaggagtggaattcgtattatcatcaatgcgtgtaa

SEQ ID NO: 312 - protein, 450 aa, M. phaseolina
MSFLATTFTSLLAVQAAQAIPFSRRAAAGLNTAAQAAGLEYFGSATDNPELTDTAYVAGLNNTADFGQITPGNSQKWDTIEASRNTFSYTKGDVIADLAEANGQKLRCHTLVWYNQLPNWVKSGGFDNATLVEILQNHIKNEVTHYKGRCAHWDVVNEALNEDGTYRDMVFYNTIGEAYIPIAFAAAAAADPEAKLYYNDYNIEWSGDKQKAAKKIVQMIQSYGVKIDGVGLQAHFTVGNTASQDAIEGVIKDFASLGVEVAITELDIRMETPATDANLKQQATDYQTVVNACLNQKDACKGITIWDYTDKYSWVPSTFSGYGAALPWDENLEKKPAYDAILSALEAAAGANSSSTSVPAANTTTPAATAPTATATKTSGSAVAAQSATSVQVAETPATTPAASTPTSGSTAGAAVARYGQCGGVNYSGSTTCESGSTCKEWNSYYHQCV

SEQ ID NO: 313 - DNA, 1818 bp, M. phaseolina
ctggcttcgacagccgcggagagtggtgggtaaactatgaaacattgcagtaccccacttggtcgccaagccgcagaaacgatatacataaagatggacaggatttccaggtcgtacgggcaagctttacatcctgtcgctgcttttgcaatgcatttgctcgtcctgctgttatccgcagctgcggcttcggcccagagctcctcaatcactttcaactcatccggcaatccaatccttgcggacggctcgtattactcagcggatccagctccactagtggttaacaatactttatacatcatcgcagggcatgacgaggcgcccgtggaccaaaacgcgtttattatcaatgagtgggagctgtttgtgtcggcttcaccagacccttcgggcggagaatggaccttctaccccggcctcgcacgaccccacgaaatattctcctgggctgcgcaagggaccgcctacgccgcccagatagtccagggcccagacgacaagttttacctgtacgcgcctgtgacagaagcagattctaagaactcagatccattcgcaatcggagttgcagtttccgatagccccctgggcccctggaccgatgctcacccttccggcccggtcttttcgcaatccgtacccgcgcccggaaacagcatccaaaacatagaccccactattctcgtggatgacgaccaaaaagtgtatgtcttttatggcacctttgggcagctccgagcctacgaaatggccgacgacatggtcactccggcatcaaatgtcaccattattgacactttgactggcttctttgaagcaccctgggtcatgaagaggaatggcacgtactacatgctgtatgcggcaaacaacgcaggaccggaatctccctgcacgcccacctcataccatgcgtgcatcgcctacggaaccgcctcatcgcctctcggcccctggacattccgcggtgttgttctgggcatcgtctcctccacaacctctcaccccggcgctgtcgaagtgggcggtgaatggttcatcgtctaccatacagcggacgcagagggcggcgggcacttccggcgcagcgttgccctcgatcgtctgaccttcgatgatgcccagtctcccccggccatcaacaaagtcgtgcaaacgaagcgcccgcaacctgcaccggcgccgacccgcaatattgcgcccaaaggaaaagcggcttcggtcagagggacgccgatccaatactgggttgaatcccttcacgacggcgaaattcccgcgaatcctcttcccccggactactggagctcctacgacggtgaatcttcgccgcaggagagcactcttgtttatgaatgggacgagccggtttctctaaatggtgtgcgcatggttttcttctccgatcagcccgccggcgccgacgtcggtgtaccgccgccgtccagctggcatgtggagttcaagaactcagacggcgcatgggaaccagtttccaactcgacggcatatccgctcgacgttactgatgacccagaagaggtctcatttgctgaaatcaacacggtttccatccgagccatattgggtgcgtcaggaagtggagagcaatacggcggtgtggcggtaaaggagtgggaagcattggcgccaaacgccgaataagagcaatctcatatgcaacgttcaacatggtacgtagcgtcgctggcatgcggcctgcatggaacacgtgttcttgtatatactcatcaatcaaggaaaccgacctccactttgttacggcagtttagcttccacaaaatttcaggggca

SEQ ID NO: 314 - DNA, 1518 bp, M. phaseolina
atgcatttgctcgtcctgctgttatccgcagctgcggcttcggcccagagctcctcaatcactttcaactcatccggcaatccaatccttgcggacggctcgtattactcagcggatccagctccactagtggttaacaatactttatacatcatcgcagggcatgacgaggcgcccgtggaccaaaacgcgtttattatcaatgagtgggagctgtttgtgtcggcttcaccagacccttcgggcggagaatggaccttctaccccggcctcgcacgaccccacgaaatattctcctgggctgcgcaagggaccgcctacgccgcccagatagtccagggcccagacgacaagttttacctgtacgcgcctgtgacagaagcagattctaagaactcagatccattcgcaatcggagttgcagtttccgatagccccctgggcccctggaccgatgctcacccttccggcccggtcttttcgcaatccgtacccgcgcccggaaacagcatccaaaacatagaccccactattctcgtggatgacgaccaaaaagtgtatgtcttttatggcacctttgggcagctccgagcctacgaaatggccgacgacatggtcactccggcatcaaatgtcaccattattgacactttgactggcttctttgaagcaccctgggtcatgaagaggaatggcacgtactacatgctgtatgcggcaaacaacgcaggaccggaatctccctgcacgcccacctcataccatgcgtgcatcgcctacggaaccgcctcatcgcctctcggcccctggacattccgcggtgttgttctgggcatcgtctcctccacaacctctcaccccggcgctgtcgaagtgggcggtgaatggttcatcgtctaccatacagcggacgcagagggcggcgggcacttccggcgcagcgttgccctcgatcgtctgaccttcgatgatgcccagtctcccccggccatcaacaaagtcgtgcaaacgaagcgcccgcaacctgcaccggcgccgacccgcaatattgcgcccaaaggaaaagcggcttcggtcagagggacgccgatccaatactgggttgaatcccttcacgacggcgaaattcccgcgaatcctcttcccccggactactggagctcctacgacggtgaatcttcgccgcaggagagcactcttgtttatgaatgggacgagccggtttctctaaatggtgtgcgcatggttttcttctccgatcagcccgccggcgccgacgtcggtgtaccgccgccgtccagctggcatgtggagttcaagaactcagacggcgcatgggaaccagtttccaactcgacggcatatccgctcgacgttactgatgacccagaagaggtctcatttgctgaaatcaacacggtttccatccgagccatattgggtgcgtcaggaagtggagagcaatacggcggtgtggcggtaaaggagtgggaagcattggcgccaaacgccgaataa

SEQ ID NO: 315 - protein, 505 aa, M. phaseolina
MHLLVLLLSAAAASAQSSSITFNSSGNPILADGSYYSADPAPLVVNNTLYIIAGHDEAPVDQNAFIINEWELFVSASPDPSGGEWTFYPGLARPHEIFSWAAQGTAYAAQIVQGPDDKFYLYAPVTEADSKNSDPFAIGVAVSDSPLGPWTDAHPSGPVFSQSVPAPGNSIQNIDPTILVDDDQKVYVFYGTFGQLRAYEMADDMVTPASNVTIIDTLTGFFEAPWVMKRNGTYYMLYAANNAGPESPCTPTSYHACIAYGTASSPLGPWTFRGVVLGIVSSTTSHPGAVEVGGEWFIVYHTADAEGGGHFRRSVALDRLTFDDAQSPPAINKVVQTKRPQPAPAPTRNIAPKGKAASVRGTPIQYWVESLHDGEIPANPLPPDYWSSYDGESSPQESTLVYEWDEPVSLNGVRMVFFSDQPAGADVGVPPPSSWHVEFKNSDGAWEPVSNSTAYPLDVTDDPEEVSFAEINTVSIRAILGASGSGEQYGGVAVKEWEALAPNAE

SEQ ID NO: 316 - DNA, 1570 bp, M. phaseolina
tccgcccacatagtcggttccggttaatgcggtcgtgcaatggacagctcgcaggcggcttaaaacggttgcatggccgcgccgcacgcttccccctctcctccctcccctcctcccgcgcccggcaactcgccgtaccgtcgagttgcaatgcccgctctactcttcctcctgccgctccttgcgagctacgctgctgcccagtacaaggggacattcgacggctctgcagcactgcttcgttcccgccagtccgccaacactagcggcgccaccttcacgaaccccattctggacgacgtgggcgcggacccgtgggttttccgtcacaatgactactactgtgggtgtttgaaaatggaactgccgggagcaggtaccgtatgcaaatgctaatttccatccaagacctcatgtacacgaactcggtcaacattaccctcttgcgcactaccatcttgaccgactggaacactgccgagtcccgtctgctcttccagccgcctgcgggcaccaactactccaccaacctgtgggctcccgagctgcaccaactcgacggcaactggtatgtcatcttcaccgccgatcctaacaacgacagtccgcctcccgaggtcgacatgtattgtgatttcaactgtcctgcgttctttcatcgcatgtgagtcgattgttccctcacagatcaagagcatttctagaacaccattgttccaggtacgtcttggagggcctcggagacgacccgtgggaggccagcttcaccttcaaggccgagctcaatacgttcgaccaattcgccatcgacgggacctacttccagcactcaaccggcctctaccacgtctactcgtgctggatccggcagtacgacgcgtggcccgccaacctgtgcatcacggccatgagcaacccgtggaccgtgtcgtccaacatctcggagcgccaggttatcagcatgccgacgaatccgtgggagaagacgccgtacggccgcccgttcaacgaccgcctcagctccaacgaggggccgcagcagctcactaaccctaccaccaaccagaccttcctcatctacagcgccgcccgctccgacaaccgcaactactgcctcggccagctcgagctcgtcggcgacgaccccatgaacccccaggactggcgcaagaacaacgacggctgcgtcttctaccaggacgctcgcaaccaggcttacggcgtcggccatgccagcttcaccaagagcccggatggcaccgaggactggatcgtgtatcatggcatgcgcaacccgatcacagggtgggcggcgaggacgattcgtgcgcagaagtttgagtggaatggggacggcagtccagctttcccgaggcccgggtatgggccttatcccgtgcccgctggacaacagtcgtgagtttggtggccgtttgctttaggagacggggccgcaaaaaaagggctgaggcttaaatcgcccgcggagaatgatgagccaccagactatatgctctagtgcagtctcgacattatctgaagaggttgcgttctggatatacctttccca

SEQ ID NO: 317 - DNA, 1149 bp, M. phaseolina
atgcccgctctactcttcctcctgccgctccttgcgagctacgctgctgcccagtacaaggggacattcgacggctctgcagcactgcttcgttcccgccagtccgccaacactagcggcgccaccttcacgaaccccattctggacgacgtgggcgcggacccgtgggttttccgtcacaatgactactactacctcatgtacacgaactcggtcaacattaccctcttgcgcactaccatcttgaccgactggaacactgccgagtcccgtctgctcttccagccgcctgcgggcaccaactactccaccaacctgtgggctcccgagctgcaccaactcgacggcaactggtatgtcatcttcaccgccgatcctaacaacgacagtccgcctcccgaggtcgacatgtattgtgatttcaactgtcctgcgttctttcatcgcatgtacgtcttggagggcctcggagacgacccgtgggaggccagcttcaccttcaaggccgagctcaatacgttcgaccaattcgccatcgacgggacctacttccagcactcaaccggcctctaccacgtctactcgtgctggatccggcagtacgacgcgtggcccgccaacctgtgcatcacggccatgagcaacccgtggaccgtgtcgtccaacatctcggagcgccaggttatcagcatgccgacgaatccgtgggagaagacgccgtacggccgcccgttcaacgaccgcctcagctccaacgaggggccgcagcagctcactaaccctaccaccaaccagaccttcctcatctacagcgccgcccgctccgacaaccgcaactactgcctcggccagctcgagctcgtcggcgacgaccccatgaacccccaggactggcgcaagaacaacgacggctgcgtcttctaccaggacgctcgcaaccaggcttacggcgtcggccatgccagcttcaccaagagcccggatggcaccgaggactggatcgtgtatcatggcatgcgcaacccgatcacagggtgggcggcgaggacgattcgtgcgcagaagtttgagtggaatggggacggcagtccagctttcccgaggcccgggtatgggccttatcccgtgcccgctggacaacagtcgtga

SEQ ID NO: 318 - protein, 382 aa, M. phaseolina
MPALLFLLPLLASYAAAQYKGTFDGSAALLRSRQSANTSGATFTNPILDDVGADPWVFRHNDYYYLMYTNSVNITLLRTTILTDWNTAESRLLFQPPAGTNYSTNLWAPELHQLDGNWYVIFTADPNNDSPPPEVDMYCDFNCPAFFHRMYVLEGLGDDPWEASFTFKAELNTFDQFAIDGTYFQHSTGLYHVYSCWIRQYDAWPANLCITAMSNPWTVSSNISERQVISMPTNPWEKTPYGRPFNDRLSSNEGPQQLTNPTTNQTFLIYSAARSDNRNYCLGQLELVGDDPMNPQDWRKNNDGCVFYQDARNQAYGVGHASFTKSPDGTEDWIVYHGMRNPITGWAARTIRAQKFEWNGDGSPAFPRPGYGPYPVPAGQQS

SEQ ID NO: 319 - DNA, 1785 bp, M. phaseolina
tgatcgccgcgccgccgccgcagcagacccggaaccggccactctggagagctggacgctcgccgcagggttcgctcgtatttgtacgacctgctccgccgacaagcttcgtcgcgtcttcctccccgaaactctattcgacccggcatcatgacttacaacaactcgctcatcacctgcactccccatgccactcccgaccccttcgtcacccacgccaatggcaagttctacttggtatgcacgccccgcctttcagcgaggcggagcggtagctctgcggggctccgtcccgcattccccgctcaccagttaagatcgctgacttctttctagaccttcactgccggtgaccgcgtcgaggtctggtgctccgacaacgtgctcagcttccacaatgcctccaagcatgtcatttggtaggtgggccttttcttttcttttcttctttttccctttcctctctctctctctctctcttcacccctcaatcaagtcgttggttcttttccctccatgtatttcattatttcactaccttctcttcatccgcaccctgagcgtgatccgtccacgctctcgctccctattcttcttcactctccttcgaattcgccgtgctgacgcccaccaggaagcccccgccaggcaccgagtactccggcggcatctgggctcccgaaatccacgtcgtagacggccgctggtactgctatgtcgcctgcgaggaccccaagcacggcaacaagtctcacagggcacgttccagcaccatcagtcccaaaagaaacctcccactaacctgccctccagatctacgtcatcggcgggcctcccggccacgaagacccctgccacggacagtgggagttcctgggccgcctgcgcggcctcccgcacgaccaatgggccatcgacggcaccgtcgtccacctcaacaaccaaaagtacttcatctacagcggctggccgctcggcgagctcaactccgacaagacccaggagctcttcatcgtgcggctgctcagccccgttgaagccgacgcctcgcgcccgcccgtcaagatctcgcacccggactacccgtgggagcgcagcgggccgagcggcatcaacgagggcccgcagtacctcgcctcgcccgacggctcctggatcggcatcgcgtacagctgcgcgggctcgtggacgcgcgactacaagatgaacacgatccgctacgacccgagccacgacccgctcgacccgcgcgcctggcgcaagagcgacaagccgctcatctgcgcccccgacagcgacgcctgcgggccctacggccccggccacggcaacttcgtccccatccgcgacgacgagatcctcgccgtcttccacgccaccgacagccccaccgacggctgggagaaccgcaagggccgctgccagcgcgtcaactggaccaggaacggccccgacatgggcaactgctgcggccccgtctgcaatagcgttgaagatttcatgaagggcgggcatgcgcaggcttggaatggcgccggcagccacggaggcggcgccggcagtctggaggacaagctgcacggcttcctgaacaaggctaaggacaaggtcgagcagaagctcagggagttgtaaaatccgaagtttttaaaggaaaaaaaaaaaaaaaaacgagaaaaagaagagagggtattctcccttttccgtagcattgtatgatattatacatttgagcgcggcaccgacctctaggccggcttttgcgataacgaaccatatataata

SEQ ID NO: 320 - DNA, 1116 bp, M. phaseolina
atgacttacaacaactcgctcatcacctgcactccccatgccactcccgaccccttcgtcacccacgccaatggcaagttctacttgaccttcactgccggtgaccgcgtcgaggtctggtgctccgacaacgtgctcagcttccacaatgcctccaagcatgtcatttggaagcccccgccaggcaccgagtactccggcggcatctgggctcccgaaatccacgtcgtagacggccgctggtactgctatgtcgcctgcgaggaccccaagcacggcaacaagtctcacaggatctacgtcatcggcgggcctcccggccacgaagacccctgccacggacagtgggagttcctgggccgcctgcgcggcctcccgcacgaccaatgggccatcgacggcaccgtcgtccacctcaacaaccaaaagtacttcatctacagcggctggccgctcggcgagctcaactccgacaagacccaggagctcttcatcgtgcggctgctcagccccgttgaagccgacgcctcgcgcccgcccgtcaagatctcgcacccggactacccgtgggagcgcagcgggccgagcggcatcaacgagggcccgcagtacctcgcctcgcccgacggctcctggatcggcatcgcgtacagctgcgcgggctcgtggacgcgcgactacaagatgaacacgatccgctacgacccgagccacgacccgctcgacccgcgcgcctggcgcaagagcgacaagccgctcatctgcgcccccgacagcgacgcctgcgggccctacggccccggccacggcaacttcgtccccatccgcgacgacgagatcctcgccgtcttccacgccaccgacagccccaccgacggctgggagaaccgcaagggccgctgccagcgcgtcaactggaccaggaacggccccgacatgggcaactgctgcggccccgtctgcaatagcgttgaagatttcatgaagggcgggcatgcgcaggcttggaatggcgccggcagccacggaggcggcgccggcagtctggaggacaagctgcacggcttcctgaacaaggctaaggacaaggtcgagcagaagctcagggagttgtaa

SEQ ID NO: 321 - protein, 371 aa, M. phaseolina
MTYNNSLITCTPHATPDPFVTHANGKFYLTFTAGDRVEVWCSDNVLSFHNASKHVIWKPPPGTEYSGGIWAPEIHVVDGRWYCYVACEDPKHGNKSHRIYVIGGPPGHEDPCHGQWEFLGRLRGLPHDQWAIDGTVVHLNNQKYFIYSGWPLGELNSDKTQELFIVRLLSPVEADASRPPVKISHPDYPWERSGPSGINEGPQYLASPDGSWIGIAYSCAGSWTRDYKMNTIRYDPSHDPLDPRAWRKSDKPLICAPDSDACGPYGPGHGNFVPIRDDEILAVFHATDSPTDGWENRKGRCQRVNWTRNGPDMGNCCGPVCNSVEDFMKGGHAQAWNGAGSHGGGAGSLEDKLHGFLNKAKDKVEQKLREL

SEQ ID NO: 322 - DNA, 1754 bp, M. phaseolina
caagcgggcggttggaaggaccatggcgttactataagacgtcctcggcttccctgttcctggcccaggtacctcgtccattaccgagctccctgttccctggccgatcgacctctttctcgcctttcgtctgagcctttttcacggagcatgtttttctctagcttgttcgccgcgtcgctggcggcgttggcccagttggctgcggccgcgaattactcgaaccccctccggcagaccgatggcagtgatcctcagatcgtctggcacgatggatactattatctgatgacgacgacctggacagacgtccagcttacgagggccacgacccttgagggattgaagaccggtgagaggaagacagtgtgggtggatgaggacccatcccggtgctgcagtgtctgggctcctggtatgtgaatacttgtttcatttgagcttaaagtcgtgcccatcactattctctctttccatcagaactgcacatcatggcagtcgtttgttttgtcggcgccgcacaaaagacgggatacgaggccaaagtgactggcctagcagctggttacagtcactatactgaactgcacgtccactcatacccagccagacgggctagcgcaatcttgagaggaggagctgctgaatccactgcttgatgagctccgtggaaaatgtttaattgatcgggatgccgtacatggacctctttgttttcatttatcgttgtgcactttgtcaatcaattgctgacgctttgatagaactgcacgagctcgacggaacttggtacatttactatactgccggcaccgcggagaacctcgatggccagcgtcctcaagtccttgaaggtaaattacaaatagccatccgaagaagaacaacccactaatcactccgcgcaggcggtgctcacccttgggatgacgactacgcctgggttgccaccctgacgtccacctggggcatcgacggatccgtcgccaccattgacaaccaacgctacttcacctggtcctgcttcgacggcaccgatatccaatccctctgcattgcctccatgacctcacctacctcgctcggccccaccgtcctgatctccgagcccaccgaagactggtaaaaagcccctccaccccctctcaccagcaccaaacccccactaacccaccactcccagggaaattgtcggcgctcccgtcaacgaaggcccctacctcctccaaagcccagtcagcggcacctactacattgtcttctccgcctcctactgctggaccacctcctaccagctcggcttgctcacgctggcctccggcgccgacccgctggtccgcgagtcctggaccaagtccggcccggtcttctcgtccgccaacggcaacctagggacggcgcacaacgccttcttcacctcgcccgacggcaccgagacgtggaacgtgtatcacgcgacggccaacgcgaacggcgcgtgcgatggcaatcggtacaccagcgtcgatagggtgagttggcgggaggatggcagtccggatttcggcgtcgccagcgcgctgggggttgtgctgcaggggcccgctggggagccggatgcgtgagcgacgggccgttgtggattcttcggtgaattttcgttctgagcgttatggtaggatgatgaaaatttatgaattcaagctttcaaggttgtacgatgaatgccgtttccgcgaggagtaaaaaaaaggccaaacgcatgcccatttgct

SEQ ID NO: 323 - DNA, 990 bp, M. phaseolina
atgtttttctctagcttgttcgccgcgtcgctggcggcgttggcccagttggctgcggccgcgaattactcgaaccccctccggcagaccgatggcagtgatcctcagatcgtctggcacgatggatactattatctgatgacgacgacctggacagacgtccagcttacgagggccacgacccttgagggattgaagaccggtgagaggaagacagtgtgggtggatgaggacccatcccggtgctgcagtgtctgggctcctgaactgcacgagctcgacggaacttggtacatttactatactgccggcaccgcggagaacctcgatggccagcgtcctcaagtccttgaaggcggtgctcacccttgggatgacgactacgcctgggttgccaccctgacgtccacctggggcatcgacggatccgtcgccaccattgacaaccaacgctacttcacctggtcctgcttcgacggcaccgatatccaatccctctgcattgcctccatgacctcacctacctcgctcggccccaccgtcctgatctccgagcccaccgaagactgggaaattgtcggcgctcccgtcaacgaaggcccctacctcctccaaagcccagtcagcggcacctactacattgtcttctccgcctcctactgctggaccacctcctaccagctcggcttgctcacgctggcctccggcgccgacccgctggtccgcgagtcctggaccaagtccggcccggtcttctcgtccgccaacggcaacctagggacggcgcacaacgccttcttcacctcgcccgacggcaccgagacgtggaacgtgtatcacgcgacggccaacgcgaacggcgcgtgcgatggcaatcggtacaccagcgtcgatagggtgagttggcgggaggatggcagtccggatttcggcgtcgccagcgcgctgggggttgtgctgcaggggcccgctggggagccggatgcgtga

SEQ ID NO: 324 - protein, 329 aa, M. phaseolina
MFFSSLFAASLAALAQLAAAANYSNPLRQTDGSDPQIVWHDGYYYLMTTTWTDVQLTRATTLEGLKTGERKTVWVDEDPSRCCSVWAPELHELDGTWYIYYTAGTAENLDGQRPQVLEGGAHPWDDDYAWVATLTSTWGIDGSVATIDNQRYFTWSCFDGTDIQSLCIASMTSPTSLGPTVLISEPTEDWEIVGAPVNEGPYLLQSPVSGTYYIVFSASYCWTTSYQLGLLTLASGADPLVRESWTKSGPVFSSANGNLGTAHNAFFTSPDGTETWNVYHATANANGACDGNRYTSVDRVSWREDGSPDFGVASALGVVLQGPAGEPDA

SEQ ID NO: 325 - DNA, 1463 bp, M. phaseolina
ctcgactcctggctttaccatgggctgattcgcggaactgcaaaggcagactaacctgcgtccacgggtgactgctctgcccggataccatttcactcaaccttggcgtccatataaagaggtgcgaatcgcctccttcttgagcaagacatgcgcgtcgctcttcctaccatatcggacagcatgagaccgttcgcttcgctgatttgctgggtcttctgggctcaggctcaccttgtcggagccgcaactttttccaacccactcaagaaccccaatggctccgatccgcacatcgtgtggtctggtggttactactatttaatgacaaccacatggaccaatctgcaaatcacgcgcgcgacgaccttgaacggtctgaagacgggagagacgaagacggtgtggacggatacaaactcggcgcgttgctgcaatgtgtgggctccggagctccattactttgacggaacgtcagtcactcagttcaattcatgccaatctgctcaagttacttacccagagcacagctggtacatttactacactgccggaaacagcgcgaacctggacggccagcgacctcatgtgctcaagggtaagccccggaaatcaaagtccatggacaagagatcctaacagagcttctaggcggcgccactccgtgggacagctggagctatctcgcgcagctcaccactacctggggcatcgacggcaccatcctccgcttcacctccggcaattacttcgtcttctcctgcatgagcaatagccttcaatccctgtgcatcgccccgctcaactcccccggcagcattggcagcatcaaggtcctctcccagcccaccgcctcctgggagaccgtcggcgcccccgtgcaagagggccccgcggccatgtaccatggcggcaagacgtacctgacctattccgccagctactgctggacctccagctaccaactcgggctgctgacctggaacggcggcgatcctacgtcgtcgagcagctgggtgaagacggggccggtattcaagtcggcgaatggaaattatggaacgggccacaacgggtatgcatctccgccagtccttcttgatgaaaggtctctgacaggaaacaggttcttccaaagccccgatggcacggagatctggaatgtgtaccacgcgacctccaacagcggcggcgggtgcgacggcaacaggtatacgatggcgcagaaggtcaactggaactcggacggatcgcctaatttcggcactgcagctgctctgggcacgacacttgcggggccttctggagagtagtttagttcatccagccgtaattctggcggagcggactggaatggatagcaaaggagagaggataaaaacaattctcggaatcaagcccgaaaacaaaatagatagacctttctcgcctgcgggagtctttctccaatgccaatatccatt

SEQ ID NO: 326 - DNA, 1002 bp, M. phaseolina
atgcgcgtcgctcttcctaccatatcggacagcatgagaccgttcgcttcgctgatttgctgggtcttctgggctcaggctcaccttgtcggagccgcaactttttccaacccactcaagaaccccaatggctccgatccgcacatcgtgtggtctggtggttactactatttaatgacaaccacatggaccaatctgcaaatcacgcgcgcgacgaccttgaacggtctgaagacgggagagacgaagacggtgtggacggatacaaactcggcgcgttgctgcaatgtgtgggctccggagctccattactttgacggaacctggtacatttactacactgccggaaacagcgcgaacctggacggccagcgacctcatgtgctcaagggcggcgccactccgtgggacagctggagctatctcgcgcagctcaccactacctggggcatcgacggcaccatcctccgcttcacctccggcaattacttcgtcttctcctgcatgagcaatagccttcaatccctgtgcatcgccccgctcaactcccccggcagcattggcagcatcaaggtcctctcccagcccaccgcctcctgggagaccgtcggcgcccccgtgcaagagggccccgcggccatgtaccatggcggcaagacgtacctgacctattccgccagctactgctggacctccagctaccaactcgggctgctgacctggaacggcggcgatcctacgtcgtcgagcagctgggtgaagacggggccggtattcaagtcggcgaatggaaattatggaacgggccacaacgggttcttccaaagccccgatggcacggagatctggaatgtgtaccacgcgacctccaacagcggcggcgggtgcgacggcaacaggtatacgatggcgcagaaggtcaactggaactcggacggatcgcctaatttcggcactgcagctgctctgggcacgacacttgcggggccttctggagagtag

SEQ ID NO: 327 - protein, 333 aa, M. phaseolina
MRVALPTISDSMRPFASLICWVFWAQAHLVGAATFSNPLKNPNGSDPHIVWSGGYYYLMTTTWTNLQITRATTLNGLKTGETKTVWTDTNSARCCNVWAPELHYFDGTWYIYYTAGNSANLDGQRPHVLKGGATPWDSWSYLAQLTTTWGIDGTILRFTSGNYFVFSCMSNSLQSLCIAPLNSPGSIGSIKVLSQPTASWETVGAPVQEGPAAMYHGGKTYLTYSASYCWTSSYQLGLLTWNGGDPTSSSSWVKTGPVFKSANGNYGTGHNGFFQSPDGTEIWNVYHATSNSGGGCDGNRYTMAQKVNWNSDGSPNFGTAAALGTTLAGPSGE

SEQ ID NO: 328 - DNA, 2524 bp, M. phaseolina
cccacccgccggcttcaccatcgccgtggcgtgctcgttcttagacggccgcagacgctgttcacgaaagcctagcagcctgcatccatccacccgtcaacccagcacattccctcctcacgccaggaactgccaattctcgccccagccatggcgaccttcaccaagatctccgagaacgacacgcccagcatttccctcaaccccgcccacaggatctccaagatcaacgacaatgtttatggtggatttaccgagtatgtgtgcctgtgtctctcagcccgccactggcgatcgagaacggcatagctgcttcctatcaccgccctttgcccaccgctgaccgtcccgcttctgtcccctgccagacacatgggccgctgcatttacggcggcatttacgaccctggcaacccgctctccgacgaacacggcttccgcaaagacgtcattgaggcctttcaggagcttaactgccccgtcgtccgttaccccggcggcaatttcgtcgctacctaccactggctcgatggcgttgggcccaaggcccaacggcctccgaggtaagcctgcttgatttctattcccttttccaggtttctaaaatctccggcaatcgtattcatgccgctgctccggctactgccgtgccgttacttgcatgcggctctgcagctgacggtggttgcctcatcaggcaacgatcggtgtcggcgccgattgctgccttggtattcttttcccttcaccacgccttcacgtgacgcctacattcgagctcgcctttatgcacagctgtagcaagctgcataggtggagtggagttacatgtcgggatatctcgggtctcagcgctgctccgtccatgctcgcttcccgagcacttcacacttcactgtgctgttgcccccgtccccgtagtcctgcttgccttgcctctgcatgcttccaacccaaattttggtcgccatggatgtggacagtccaccgaaaatcaccgcacatgaattgatgaactgaaatcttgatcatagacctgagctagcatggctcggcctggaaaccaacgagttcggcaccgatgagttcctcaagtggtgcgaagtcgtcggaaccgagccctacttcgccctgaactttggtactggaacgcttgatgaaggtcagtaggaatatggaattcgttgtcagccacggcggcgagtaactgacggacactagctctcggctggatcgagtactgcaactcctcgcaaaacacctactacgccaacctccgtcgcaagaatggccgcgaaaagccatacaacgtatgccaaagtcctctccgccgatgccctttccttcactgacagccacaatccaggtcaaatactgggccttgggcaacgagatgtgggggccctggcaagtcggccaaatgaccaaggaggactacgcgcacaaggcctaccaatgggccaaggcgatcaagctgctcgacccgtccgtcgagctcattctctgtggccaggatggcactagcacatgggacacttacgtgatcaaagagtgcatccgctgggagccgcacgcgctgggcggctcgcagacggcgtcgctcatcgccatgcacagcatccacatctacacagccgcccaggaacacctgcccaacgcgacggcgccccgcagcgctgagcgcgccatcgagatcaccgccggtctcatcgacctcgcccgcgccgagaacaaggttccccataccgcgccgcgcccgaccatctgcttcgacgagtggaatgtctgggaccccgtccgcgcccccggtgagctcggggccgaggagaagtacacgctgtcggacgccctggctgtcgccgtgtggctgaacgtcttcatccgccagagcaagcacgtcggcatggcgaatatcgcccagagcgtcaacgttatctcgccgctcatgaccaacaaagacggcctcgtcaagcagaccacctggtggccgctgctgctgttcagcaagtacatgcgcggtcacacactcgccgtcaatgttcgcgcggcggagtacgagggccccacggcgcccgcttggctcagaggcacgatcgagacgccctacttggatgtctcagctgccatcaccgatgatggatacgttggcctggctgtggtgaatgtgcatgagagcaaggccttcgagactgatctcgagggcgtcgtgagtaaggagggtggcgttaaggtgtataccgttacgggctctggctgggaggtagtcaacacggagtcgaagcaggaggtcggcattaaagagagcgattgggatggaaagggcaagtttacattcccgaagttgagctttacgttgttgaggtggaaggcctaggttagggacggtgtggtgtggctatggttgcctgagcatatagatttgttctctgatagaatcacaactgcatcatggttttggcgtttaaatctatgctacgctcgcagatcttttacttatggcaaccagtgcgcaaggggagttgaa

SEQ ID NO: 329 - DNA, 1527 bp, M. phaseolina
atggcgaccttcaccaagatctccgagaacgacacgcccagcatttccctcaaccccgcccacaggatctccaagatcaacgacaatgtttatggtggatttaccgaacacatgggccgctgcatttacggcggcatttacgaccctggcaacccgctctccgacgaacacggcttccgcaaagacgtcattgaggcctttcaggagcttaactgccccgtcgtccgttaccccggcggcaatttcgtcgctacctaccactggctcgatggcgttgggcccaaggcccaacggcctccgagacctgagctagcatggctcggcctggaaaccaacgagttcggcaccgatgagttcctcaagtggtgcgaagtcgtcggaaccgagccctacttcgccctgaactttggtactggaacgcttgatgaagctctcggctggatcgagtactgcaactcctcgcaaaacacctactacgccaacctccgtcgcaagaatggccgcgaaaagccatacaacgtcaaatactgggccttgggcaacgagatgtgggggccctggcaagtcggccaaatgaccaaggaggactacgcgcacaaggcctaccaatgggccaaggcgatcaagctgctcgacccgtccgtcgagctcattctctgtggccaggatggcactagcacatgggacacttacgtgatcaaagagtgcatccgctgggagccgcacgcgctgggcggctcgcagacggcgtcgctcatcgccatgcacagcatccacatctacacagccgcccaggaacacctgcccaacgcgacggcgccccgcagcgctgagcgcgccatcgagatcaccgccggtctcatcgacctcgcccgcgccgagaacaaggttccccataccgcgccgcgcccgaccatctgcttcgacgagtggaatgtctgggaccccgtccgcgcccccggtgagctcggggccgaggagaagtacacgctgtcggacgccctggctgtcgccgtgtggctgaacgtcttcatccgccagagcaagcacgtcggcatggcgaatatcgcccagagcgtcaacgttatctcgccgctcatgaccaacaaagacggcctcgtcaagcagaccacctggtggccgctgctgctgttcagcaagtacatgcgcggtcacacactcgccgtcaatgttcgcgcggcggagtacgagggccccacggcgcccgcttggctcagaggcacgatcgagacgccctacttggatgtctcagctgccatcaccgatgatggatacgttggcctggctgtggtgaatgtgcatgagagcaaggccttcgagactgatctcgagggcgtcgtgagtaaggagggtggcgttaaggtgtataccgttacgggctctggctgggaggtagtcaacacggagtcgaagcaggaggtcggcattaaagagagcgattgggatggaaagggcaagtttacattcccgaagttgagctttacgttgttgaggtggaaggcctag

SEQ ID NO: 330 - protein, 508 aa, M. phaseolina
MATFTKISENDTPSISLNPAHRISKINDNVYGGFTEHMGRCIYGGIYDPGNPLSDEHGFRKDVIEAFQELNCPVVRYPGGNFVATYHWLDGVGPKAQRPPRPELAWLGLETNEFGTDEFLKWCEVVGTEPYFALNFGTGTLDEALGWIEYCNSSQNTYYANLRRKNGREKPYNVKYWALGNEMWGPWQVGQMTKEDYAHKAYQWAKAIKLLDPSVELILCGQDGTSTWDTYVIKECIRWEPHALGGSQTASLIAMHSIHIYTAAQEHLPNATAPRSAERAIEITAGLIDLARAENKVPHTAPRPTICFDEWNVWDPVRAPGELGAEEKYTLSDALAVAVWLNVFIRQSKHVGMANIAQSVNVISPLMTNKDGLVKQTTWWPLLLFSKYMRGHTLAVNVRAAEYEGPTAPAWLRGTIETPYLDVSAAITDDGYVGLAVVNVHESKAFETDLEGVVSKEGGVKVYTVTGSGWEVVNTESKQEVGIKESDWDGKGKFTFPKLSFTLLRWKA

SEQ ID NO: 331 - DNA, 2628 bp, M. phaseolina
aatgactgccgtgcttcttccccgcgcttttcgtagtgcaaatttccgctacagcatgcactctgctatatagactgcggaggttcccctctgttgtgccgcgcgctgccgtcttctcaccgccgcgctgttgctgtctcgtccgtcacaatgctgagctccgtttcagctggcctctttggccttgccattcttttgccttcaacctatgctcggattcctcgtcaaggacgccagctctcggctgctccgttcatcaatgccacggcagccaatgtcagcagcgtagctttggagatcaacaccaaggacacgtcgctgcgcaacaagacagccccgtatctgtatggtttgatgcatgaagatatcaaccattccggagacggtggcatttatgctgagctcctgacgaacagagcctttcaaggctagtgacaggtacattgagtagttggataagtcgttaactgcgtgcaggctcaaacatcatcccgggcgccgtcgatggccttactggcaatctcatcattgacagcgaaaaccctgttgttccctatggacccgtcctgacgggctgggcccccattgggaatgtgcggttgacactggacgttctccatcctctctccgaggccctgcatacttctctgcagattgatgtcccagcaaacgcgactggcgaagtcggagtccaaaactttggttggtggggaatggacgtttctccccagacctacaacgcttcgttttacgtctctgccaaccagccacgctatctcagtaaccagacaaccttcacagtctcgctgcgttcgaacctcaccggtgaggtttgggtctcggagcagattggccctgtggacgtacctgttcttggctacactcaactgaatgcttctattgtcaatacggtcacggctccgaactcgaataatacgtttgcccttaccatggacgcttctgaagtcgccggacagaccctctacttctctctgttctcgctcttccccgagacattcaaggataggccgaatggtctgcggaaggacattgcgcaggctttctacgatatgaagccgcgcttcttgcgtttccctggtggcaataatcttgaaggggtctctgtagacaaacgttggaagtggtggaagaccattggcccgctcaaggaccgccctggccggcccggcaactggaactattacaacactgatggactgggtctcctcgaatatctcgagtggtgcgaagacatggagatcgagcccgtcctcgccgtgtacgccggtttctcgctcgacatctggggccagtcgggcacagactggccgcaggatcgcatgggcgaggttttgcaagaggctctggacgagctcgagtatgtcactggcgacacatcgaccaaatggggagctctgcgtgccgatcatggccatccggagccgttcgccatcaacttcatcgaaatcggcaatgaggattggttctctggcacgtatccacgccgttgggcttacctctacgagggcttgaaagccaaataccctaacgttacctacatctcttccgcgtacaatgaaaacacggagtacacgatcgatatcccggctggtgcttactgggatacacaccactatgaggtaaccgctcgatctcgcatttcctcgaactgattgtactgattttgatgatcaggaaccgagctactttctcgagaacttcgacttctatgacaattggcaaacctctaccgacaacgagggtgtcggcgtgcttcttggcgagtacagcgtctaccaggtcgacacgcccgacggtgtcgtcaacttctcgaatccaactgacatccatgtgtactatccgcgcatgatctccgccattgccgaaggcatctacgcgcttggcgctgagcgcaacccgaacaccgtcaagctcaattcgtacgcgcccagcctgcagaacagaaattggtacaactggactcccgatatgatcagctacgaggccgatcccagcaagaccgtgctcagcaccagctactggcagcagcacctgttcgcgcattaccgtggcacccagacgctgccggtcaccaacacgctgggtgacttcaacccgctctactggcagagtagcattgaagaggagacgggttctatctacctcaaggctagtttgagaatttttgtacttctttcattgaacagcaaatttctgacgagtgaagtacaggtcatcaacgccggcaacaccacaattcctctcagcgtcagcatagacgcagcctacagcaaggtcaacggcactattatgcagaatgatgacatcaacggcttcaactatgtcaacaatcagaccgccatcgttccgttcccgctcggtgacaaaggaaccgcttttcccgccaagtcctccaacggcagcttcatctggaatgtgccgatccactctatcaccgttttgcagtttgatttgtaggaacatgtaaaaaatgatggatgcatagcaagacggcgtgattgccaaagtagatgaatattaatatttgactgttccaaggactctggccaatccgtcggattctcaaatacagctgactatgtgagcattgcttatgtttgctaagta

SEQ ID NO: 332 - DNA, 2145 bp, M. phaseolina
atgctgagctccgtttcagctggcctctttggccttgccattcttttgccttcaacctatgctcggattcctcgtcaaggacgccagctctcggctgctccgttcatcaatgccacggcagccaatgtcagcagcgtagctttggagatcaacaccaaggacacgtcgctgcgcaacaagacagccccgtatctgtatggctcaaacatcatcccgggcgccgtcgatggccttactggcaatctcatcattgacagcgaaaaccctgttgttccctatggacccgtcctgacgggctgggcccccattgggaatgtgcggttgacactggacgttctccatcctctctccgaggccctgcatacttctctgcagattgatgtcccagcaaacgcgactggcgaagtcggagtccaaaactttggttggtggggaatggacgtttctccccagacctacaacgcttcgttttacgtctctgccaaccagccacgctatctcagtaaccagacaaccttcacagtctcgctgcgttcgaacctcaccggtgaggtttgggtctcggagcagattggccctgtggacgtacctgttcttggctacactcaactgaatgcttctattgtcaatacggtcacggctccgaactcgaataatacgtttgcccttaccatggacgcttctgaagtcgccggacagaccctctacttctctctgttctcgctcttccccgagacattcaaggataggccgaatggtctgcggaaggacattgcgcaggctttctacgatatgaagccgcgcttcttgcgtttccctggtggcaataatcttgaaggggtctctgtagacaaacgttggaagtggtggaagaccattggcccgctcaaggaccgccctggccggcccggcaactggaactattacaacactgatggactgggtctcctcgaatatctcgagtggtgcgaagacatggagatcgagcccgtcctcgccgtgtacgccggtttctcgctcgacatctggggccagtcgggcacagactggccgcaggatcgcatgggcgaggttttgcaagaggctctggacgagctcgagtatgtcactggcgacacatcgaccaaatggggagctctgcgtgccgatcatggccatccggagccgttcgccatcaacttcatcgaaatcggcaatgaggattggttctctggcacgtatccacgccgttgggcttacctctacgagggcttgaaagccaaataccctaacgttacctacatctcttccgcgtacaatgaaaacacggagtacacgatcgatatcccggctggtgcttactgggatacacaccactatgaggaaccgagctactttctcgagaacttcgacttctatgacaattggcaaacctctaccgacaacgagggtgtcggcgtgcttcttggcgagtacagcgtctaccaggtcgacacgcccgacggtgtcgtcaacttctcgaatccaactgacatccatgtgtactatccgcgcatgatctccgccattgccgaaggcatctacgcgcttggcgctgagcgcaacccgaacaccgtcaagctcaattcgtacgcgcccagcctgcagaacagaaattggtacaactggactcccgatatgatcagctacgaggccgatcccagcaagaccgtgctcagcaccagctactggcagcagcacctgttcgcgcattaccgtggcacccagacgctgccggtcaccaacacgctgggtgacttcaacccgctctactggcagagtagcattgaagaggagacgggttctatctacctcaaggctagtttgagaatttttgtacttctttcattgaacagcaaatttctgacgagtgaagtacaggtcatcaacgccggcaacaccacaattcctctcagcgtcagcatagacgcagcctacagcaaggtcaacggcactattatgcagaatgatgacatcaacggcttcaactatgtcaacaatcagaccgccatcgttccgttcccgctcggtgacaaaggaaccgcttttcccgccaagtcctccaacggcagcttcatctggaatgtgccgatccactctatcaccgttttgcagtttgatttgtag

SEQ ID NO: 333 - protein, 714 aa, M. phaseolina
MLSSVSAGLFGLAILLPSTYARIPRQGRQLSAAPFINATAANVSSVALEINTKDTSLRNKTAPYLYGSNIIPGAVDGLTGNLIIDSENPVVPYGPVLTGWAPIGNVRLTLDVLHPLSEALHTSLQIDVPANATGEVGVQNFGWWGMDVSPQTYNASFYVSANQPRYLSNQTTFTVSLRSNLTGEVWVSEQIGPVDVPVLGYTQLNASIVNTVTAPNSNNTFALTMDASEVAGQTLYFSLFSLFPETFKDRPNGLRKDIAQAFYDMKPRFLRFPGGNNLEGVSVDKRWKWWKTIGPLKDRPGRPGNWNYYNTDGLGLLEYLEWCEDMEIEPVLAVYAGFSLDIWGQSGTDWPQDRMGEVLQEALDELEYVTGDTSTKWGALRADHGHPEPFAINFIEIGNEDWFSGTYPRRWAYLYEGLKAKYPNVTYISSAYNENTEYTIDIPAGAYWDTHHYEEPSYFLENFDFYDNWQTSTDNEGVGVLLGEYSVYQVDTPDGVVNFSNPTDIHVYYPRMISAIAEGIYALGAERNPNTVKLNSYAPSLQNRNWYNWTPDMISYEADPSKTVLSTSYWQQHLFAHYRGTQTLPVTNTLGDFNPLYWQSSIEEETGSIYLKASLRIFVLLSLNSKFLTSEVQVINAGNTTIPLSVSIDAAYSKVNGTIMQNDDINGFNYVNNQTAIVPFPLGDKGTAFPAKSSNGSFIWNVPIHSITVLQFDL

SEQ ID NO: 334 - DNA, 3344 bp, M. phaseolina
cggccgtccgatcgcgcgcccgacgctgctttgcccgacgcggagctctgggcgcccgctatatgaaggcagaatgtcgccagctgcgaggagcaggcccggccaggagactgtcttcgagcgggcgcaatgctgtcgccgccctccacgatggcgcggttgctgtccttgacgtcggcgctgctgccactgcttgcccagctgccctccgcctccgcgcaggaatggccaatccacgacaccgggctcaccgatgccgtccagtgggaccactacagcttcatcgtcgagggcaagcgcgtctatctcttcggcggtgaaatgcaccccttccgcctccccgtgccggaactgtggcaggacattgtccagaagaccaaggcgctgggcttcaacaccttctccttctacaccaattggttcttccacaacccgcatcccaacgagaccgacttcgagaccgcggcacacgacatcggccgtctcctcgcctatgccaacgaggccggcctgttcgtggcggtgcgccccggtccgtacgtcaacgccgagctcaacgccggcggattcccgctgtgggtcacgacgggcgcgtacggcgagctgcgcgacgacaactcgtcctacgccggcgcctggactccctaccaggaccgcattgcccagattgtcgccccctaccagatccacaagaacggcaccgtcatcagctaccagctggagaacgaatacggcgagcaatggctcaattcgaggacgaagacgcccaacccgcccgccgtcaactacatggtccaactgcacgagaacgcgcgcaggaacggcattgacgttccgaccacccacaacagccccaatctgaacgatttctcgtggtccaaggaccaggacaccgtgggcgccggtggaaatgtggatgtcttgggactggacaactacgtgggtggccttcccgtgtgacgagatgatgatccgctgaccccctgcagcctctttgctggtcctgcgaccaatccgaatgcaccggtgtgtccaacgactacaagctcgtcgagtactacagctggttccagaggaatactccgagcgtgccatccatgatgcccgagttccagggtggccgctacaacccgctggacggagatgcgggccaatgccttgagccaatgggtcctgagttccgtaacctcttctaccgccacaacatcgatcagaaggtcaccgccatggtcctttacaccctcttcggcggaacaaactgggggtggatggccgctcccttcattggcacgagctacgattacgccgccccgattgccgaggatcggtcgctcagagacagctggtacgagacgaagagtctggcgcttttcacgagggtcgccgaggacctccgcgaggcggaccgggtgggcaacagcacctcgtacagcacgaactcggccgtgctcgccaccgagctccgcaacgccgagactggaggcgctttctacattgccagacatgccaactcagtgaccggcgagcctgtcgcgttccacctgcgcgtgaagacgtccattggaaacttgaccattccgcagagggagggacaaatcgagctcaacgctcgtgaggccaagatcgtgccgactgatttccgcttttccggacagaggctcatttactccactgccgaggttttcacgtatgttgagctggacggcaagccgactgtcgcactctgggtcccggacggcgagagcggcgagttcttccttgaaggcaaaggcaacgtctccgcaacggcctctcccagcgatggcgtcacattccaccaggatgcacgcggattgattgtcaactttgcaaaccagaccggcaccaccgtcattgataccgatgctgcgcgtttcgttctcctcgaccgcactgacgcgtggaagacgttcgctccagtgctcaccactgaccctcacgcccctgtcgaccagaccgtcctggtccaaggcccgcatctcgtccggaccgccactgtcgaggatgacactctcaagctgacaggcgataccagcgaggaaacgactcttcagatcttcgcctccgcctccatcaaggccgtcacctggaacggcgaagccctctccacaacctccaccccctacggaagcctcacagccaccctctccggccccgccgaagtcaccctcccctccctctccgccctctcctggaagacagcccccagcctgcccgaaatcgcgcccaactacacgctctcgcccgcagtctggaagcccgccaacgctagcaccacgccctcgcaattcaccgccgccacgacgccctacctctacatcgacgcgctcggcttccacgtcggcaaccacatctaccgcgcgaccttcaccggccccgcctccggcgtctacctcgcgctgcagggcggcaccggcttcgggtggagcgcctacctgaacgggcgcttcgtccacgccgagcccggctcctcggagctcgaggcgaccaacgcgacgatcgctttcaccaacgccaccgacggagaaaacgtgctcgtcatcctcatggacaacagtggccacgagcagcgcgccgaggcgctcgagatccgcggcatcaccaacgccacgctcctcggcaacggcgccggcttcgacgcctggcacgtcgccggcacggccggcgaggccgcctccacgacgctcgaccccgtgcgcggcgtgtacaacgagggcgggctggcgggcgagcgcctgggctggcacctgccgggcttcgacgactcggcgtgggccgccggctccccgagcgagggcttctctggcgcggcggtgcgcttctaccgcgcgcgcgtcgcgctggatgtgccggccgggcacgacgccgcggtgcacttcaccatgaaggcgctgggcagccaggcggtgcgcgcgctgctgtacgtgaacggctatcagtttggccgcttccggccggcggtgagcacggcgacggactttcccgtgccgccgggcgtgctggattacgcgggcgagaatgagatcgtggtggcggtgtgggcgcagagcgaggagggggcgcaggtggaggtggggtgggaggtgcagggcgttgtgaggagtgggttggatgtgagatttgatggggcatatttgaggcctggctggagcgaggagaggttggcgtatgcttagaggggaaggaggtgaagttaccgatcccgtccgaagggaggatttgtgcaaattccgctggtctgttatgggtgcttgccgtctgttccccttctttttgctggcaccggcattgagagagcttacttctgcagggttcggggcagatgg

SEQ ID NO: 335 - DNA, 2994 bp, M. phaseolina
atggcgcggttgctgtccttgacgtcggcgctgctgccactgcttgcccagctgccctccgcctccgcgcaggaatggccaatccacgacaccgggctcaccgatgccgtccagtgggaccactacagcttcatcgtcgagggcaagcgcgtctatctcttcggcggtgaaatgcaccccttccgcctccccgtgccggaactgtggcaggacattgtccagaagaccaaggcgctgggcttcaacaccttctccttctacaccaattggttcttccacaacccgcatcccaacgagaccgacttcgagaccgcggcacacgacatcggccgtctcctcgcctatgccaacgaggccggcctgttcgtggcggtgcgccccggtccgtacgtcaacgccgagctcaacgccggcggattcccgctgtgggtcacgacgggcgcgtacggcgagctgcgcgacgacaactcgtcctacgccggcgcctggactccctaccaggaccgcattgcccagattgtcgccccctaccagatccacaagaacggcaccgtcatcagctaccagctggagaacgaatacggcgagcaatggctcaattcgaggacgaagacgcccaacccgcccgccgtcaactacatggtccaactgcacgagaacgcgcgcaggaacggcattgacgttccgaccacccacaacagccccaatctgaacgatttctcgtggtccaaggaccaggacaccgtgggcgccggtggaaatgtggatgtcttgggactggacaactaccctctttgctggtcctgcgaccaatccgaatgcaccggtgtgtccaacgactacaagctcgtcgagtactacagctggttccagaggaatactccgagcgtgccatccatgatgcccgagttccagggtggccgctacaacccgctggacggagatgcgggccaatgccttgagccaatgggtcctgagttccgtaacctcttctaccgccacaacatcgatcagaaggtcaccgccatggtcctttacaccctcttcggcggaacaaactgggggtggatggccgctcccttcattggcacgagctacgattacgccgccccgattgccgaggatcggtcgctcagagacagctggtacgagacgaagagtctggcgcttttcacgagggtcgccgaggacctccgcgaggcggaccgggtgggcaacagcacctcgtacagcacgaactcggccgtgctcgccaccgagctccgcaacgccgagactggaggcgctttctacattgccagacatgccaactcagtgaccggcgagcctgtcgcgttccacctgcgcgtgaagacgtccattggaaacttgaccattccgcagagggagggacaaatcgagctcaacgctcgtgaggccaagatcgtgccgactgatttccgcttttccggacagaggctcatttactccactgccgaggttttcacgtatgttgagctggacggcaagccgactgtcgcactctgggtcccggacggcgagagcggcgagttcttccttgaaggcaaaggcaacgtctccgcaacggcctctcccagcgatggcgtcacattccaccaggatgcacgcggattgattgtcaactttgcaaaccagaccggcaccaccgtcattgataccgatgctgcgcgtttcgttctcctcgaccgcactgacgcgtggaagacgttcgctccagtgctcaccactgaccctcacgcccctgtcgaccagaccgtcctggtccaaggcccgcatctcgtccggaccgccactgtcgaggatgacactctcaagctgacaggcgataccagcgaggaaacgactcttcagatcttcgcctccgcctccatcaaggccgtcacctggaacggcgaagccctctccacaacctccaccccctacggaagcctcacagccaccctctccggccccgccgaagtcaccctcccctccctctccgccctctcctggaagacagcccccagcctgcccgaaatcgcgcccaactacacgctctcgcccgcagtctggaagcccgccaacgctagcaccacgccctcgcaattcaccgccgccacgacgccctacctctacatcgacgcgctcggcttccacgtcggcaaccacatctaccgcgcgaccttcaccggccccgcctccggcgtctacctcgcgctgcagggcggcaccggcttcgggtggagcgcctacctgaacgggcgcttcgtccacgccgagcccggctcctcggagctcgaggcgaccaacgcgacgatcgctttcaccaacgccaccgacggagaaaacgtgctcgtcatcctcatggacaacagtggccacgagcagcgcgccgaggcgctcgagatccgcggcatcaccaacgccacgctcctcggcaacggcgccggcttcgacgcctggcacgtcgccggcacggccggcgaggccgcctccacgacgctcgaccccgtgcgcggcgtgtacaacgagggcgggctggcgggcgagcgcctgggctggcacctgccgggcttcgacgactcggcgtgggccgccggctccccgagcgagggcttctctggcgcggcggtgcgcttctaccgcgcgcgcgtcgcgctggatgtgccggccgggcacgacgccgcggtgcacttcaccatgaaggcgctgggcagccaggcggtgcgcgcgctgctgtacgtgaacggctatcagtttggccgcttccggccggcggtgagcacggcgacggactttcccgtgccgccgggcgtgctggattacgcgggcgagaatgagatcgtggtggcggtgtgggcgcagagcgaggagggggcgcaggtggaggtggggtgggaggtgcagggcgttgtgaggagtgggttggatgtgagatttgatggggcatatttgaggcctggctggagcgaggagaggttggcgtatgcttag

SEQ ID NO: 336 - protein, 997 aa, M. phaseolina
MARLLSLTSALLPLLAQLPSASAQEWPIHDTGLTDAVQWDHYSFIVEGKRVYLFGGEMHPFRLPVPELWQDIVQKTKALGFNTFSFYTNWFFHNPHPNETDFETAAHDIGRLLAYANEAGLFVAVRPGPYVNAELNAGGFPLWVTTGAYGELRDDNSSYAGAWTPYQDRIAQIVAPYQIHKNGTVISYQLENEYGEQWLNSRTKTPNPPAVNYMVQLHENARRNGIDVPTTHNSPNLNDFSWSKDQDTVGAGGNVDVLGLDNYPLCWSCDQSECTGVSNDYKLVEYYSWFQRNTPSVPSMMPEFQGGRYNPLDGDAGQCLEPMGPEFRNLFYRHNIDQKVTAMVLYTLFGGTNWGWMAAPFIGTSYDYAAPIAEDRSLRDSWYETKSLALFTRVAEDLREADRVGNSTSYSTNSAVLATELRNAETGGAFYIARHANSVTGEPVAFHLRVKTSIGNLTIPQREGQIELNAREAKIVPTDFRFSGQRLIYSTAEVFTYVELDGKPTVALWVPDGESGEFFLEGKGNVSATASPSDGVTFHQDARGLIVNFANQTGTTVIDTDAARFVLLDRTDAWKTFAPVLTTDPHAPVDQTVLVQGPHLVRTATVEDDTLKLTGDTSEETTLQIFASASIKAVTWNGEALSTTSTPYGSLTATLSGPAEVTLPSLSALSWKTAPSLPEIAPNYTLSPAVWKPANASTTPSQFTAATTPYLYIDALGFHVGNHIYRATFTGPASGVYLALQGGTGFGWSAYLNGRFVHAEPGSSELEATNATIAFTNATDGENVLVILMDNSGHEQRAEALEIRGITNATLLGNGAGFDAWHVAGTAGEAASTTLDPVRGVYNEGGLAGERLGWHLPGFDDSAWAAGSPSEGFSGAAVRFYRARVALDVPAGHDAAVHFTMKALGSQAVRALLYVNGYQFGRFRPAVSTATDFPVPPGVLDYAGENEIVVAVWAQSEEGAQVEVGWEVQGVVRSGLDVRFDGAYLRPGWSEERLAYA

SEQ ID NO: 337 - DNA, 2603 bp, M. phaseolina
gaggtcacaatgcctggtcacaatgccatccttgcgcgctcccagcaccgtcgagccttcgtagagcctggcatataagtctgcgtagagtggccgtcatttccagactccgtgcttcgggaacagcagtttcctcgtccccattccaagatgcgtgtctctgcggtcctcgccctgccggttctggcagcctattctgttgctgctcagccgtttcccaacaccaccagccctcctaccggtgcagcaaccccctaccagctccaggctcctccgctcgacactccttggacagagcaagtggggacgagcccttggcccgaatatccacgtccgcaactgcgtcgtgagcaatggcagaacctcaatggcctctggacgtatcaggcagctccatccttcggggagacccccggagcccttcctgcgcttccttccactcccctgagccgcgagattctcatcccgtcctgcattgagagcggcttgtccggtatccaagagctcgacgtcaccaacttttggctcgcaacaactttcacggttcccagcaactggagcggccaggccatcctgctaaacttcgaggctgtggactacgaggctactgtcttcatcaacggccaagaggctgcatttcaccgcggtggctattggcgcttcactgtcgacgccacgcaatacgttaatttcaacgggaccaacgaattgtgagtgaaacacgcacgccgacagccttgctcggagccggggttactgacatgggtgccccagggtcgtttacgttttcgatccgacggactcgcccggctacgagatcgccaggggcaagcagacccgaaaccccagccacatcttctacaggccctgcagtggcatttggcagaccgtgtggttggagcccgccccgcgcgaccacatcacgcgattggacgttgcggctggctcggacggagcaggtaagccgggaaaaacgacgacccgccgggtagctcccctgcgacggtcgagaacccgaggattgctaacgctgcttcaaaagtcaatgtcaccgtcttcagctcctccaaccaatccgtgcccgtggagttctctattctccaggatggcaatgttattgcgacgcaggagggcaccactggcgaccccttcgacctctccgtcgactccccgcaactgtggtcgcccgactcgcccaacttgtacaacatcacggtgcgtttgggagacgatgtcgtcgagagctacaccggattccgcactatttcctcgggcatcgtcgacggcgtaaggcggcctcttctgaacggcgagttcgtcttccagttcggcacgctcgaccagggctactggcccgacggcctgtaccttgctccgaacctcgaggctctcgttttcgaccttcagctcctgaagagcttgggaatgaacatggtccgcaagcacgtaagttatgttgcatggtgcacatctcaggaggaagcttgctgacggtgattccaaaaatagattaaggtcgagcctgatctcttctaccatgcgtgcgataccctgggcctgctcgtcattcaagacatgcccagcatgctcgtggatgggggcgagcccaacgcagagcagcaggccgaatgggagcgccagctcgatatactcattactgagcacaagagctacacctgcattgttacctgggtatgcacaagctcttgtcctccggagcttaagccaaagctaattccaccgtgcttaggtaatctacaacgaaggctggggccagatccggagcaactacttccccgagtttggcctcgccgacagaatcagggcgcaggatcccagcaggctcattgacgccaccagcggctggcacgaccacggtgccggtgatttctctgtaagttatcccgggtaccttgaggggatctgtgtttaacctggttcaggataaccatcactacgccacccctcaatgtggagcgcccttctactcaactccctcggccccttacgaccccaaccgcatcggcatccagggcgagtttggcggtattggacacaatgtttccattgagaagtaagtccctcctaccaaatttatagacatccttgattaacgggccgatcacagcctctggaacgtccagcaagctattgataccatcaaccagacttacgaaatcagcgccgacctgtccgcgtacaactaccgcgcacgcgtgttgttcaacgaactggaggaccaagtccgcatgtttgcgtgcagtgccgctgtctggacgcagacgtcggatgttgagggcgaggtcaacggcctcgttacctacgaccgtcgcatcgagcgcgtcgacaggaatcagtggcaatccgacatccaggctctttacgacgccgccgcgggccgtggtggcgctggcggcaactcgtcccgggtggcgatgccgcaatatgtctgatgagttttcggcttcttttttttttttctcttctttcgtcgcgggctgagccagagcgtcggctgccgaggtgcagaaccactcctggcccaccgctatttttctcgtccagttcgagactactcgtccttccacggctctaataatccg

SEQ ID NO: 338 - DNA, 1932 bp, M. phaseolina
atgcgtgtctctgcggtcctcgccctgccggttctggcagcctattctgttgctgctcagccgtttcccaacaccaccagccctcctaccggtgcagcaaccccctaccagctccaggctcctccgctcgacactccttggacagagcaagtggggacgagcccttggcccgaatatccacgtccgcaactgcgtcgtgagcaatggcagaacctcaatggcctctggacgtatcaggcagctccatccttcggggagacccccggagcccttcctgcgcttccttccactcccctgagccgcgagattctcatcccgtcctgcattgagagcggcttgtccggtatccaagagctcgacgtcaccaacttttggctcgcaacaactttcacggttcccagcaactggagcggccaggccatcctgctaaacttcgaggctgtggactacgaggctactgtcttcatcaacggccaagaggctgcatttcaccgcggtggctattggcgcttcactgtcgacgccacgcaatacgttaatttcaacgggaccaacgaattggtcgtttacgttttcgatccgacggactcgcccggctacgagatcgccaggggcaagcagacccgaaaccccagccacatcttctacaggccctgcagtggcatttggcagaccgtgtggttggagcccgccccgcgcgaccacatcacgcgattggacgttgcggctggctcggacggagcagtcaatgtcaccgtcttcagctcctccaaccaatccgtgcccgtggagttctctattctccaggatggcaatgttattgcgacgcaggagggcaccactggcgaccccttcgacctctccgtcgactccccgcaactgtggtcgcccgactcgcccaacttgtacaacatcacggtgcgtttgggagacgatgtcgtcgagagctacaccggattccgcactatttcctcgggcatcgtcgacggcgtaaggcggcctcttctgaacggcgagttcgtcttccagttcggcacgctcgaccagggctactggcccgacggcctgtaccttgctccgaacctcgaggctctcgttttcgaccttcagctcctgaagagcttgggaatgaacatggtccgcaagcacattaaggtcgagcctgatctcttctaccatgcgtgcgataccctgggcctgctcgtcattcaagacatgcccagcatgctcgtggatgggggcgagcccaacgcagagcagcaggccgaatgggagcgccagctcgatatactcattactgagcacaagagctacacctgcattgttacctgggtaatctacaacgaaggctggggccagatccggagcaactacttccccgagtttggcctcgccgacagaatcagggcgcaggatcccagcaggctcattgacgccaccagcggctggcacgaccacggtgccggtgatttctctgataaccatcactacgccacccctcaatgtggagcgcccttctactcaactccctcggccccttacgaccccaaccgcatcggcatccagggcgagtttggcggtattggacacaatgtttccattgagaacctctggaacgtccagcaagctattgataccatcaaccagacttacgaaatcagcgccgacctgtccgcgtacaactaccgcgcacgcgtgttgttcaacgaactggaggaccaagtccgcatgtttgcgtgcagtgccgctgtctggacgcagacgtcggatgttgagggcgaggtcaacggcctcgttacctacgaccgtcgcatcgagcgcgtcgacaggaatcagtggcaatccgacatccaggctctttacgacgccgccgcgggccgtggtggcgctggcggcaactcgtcccgggtggcgatgccgcaatatgtctga

SEQ ID NO: 339 - protein, 643 aa, M. phaseolina
MRVSAVLALPVLAAYSVAAQPFPNTTSPPTGAATPYQLQAPPLDTPWTEQVGTSPWPEYPRPQLRREQWQNLNGLWTYQAAPSFGETPGALPALPSTPLSREILIPSCIESGLSGIQELDVTNFWLATTFTVPSNWSGQAILLNFEAVDYEATVFINGQEAAFHRGGYWRFTVDATQYVNFNGTNELVVYVFDPTDSPGYEIARGKQTRNPSHIFYRPCSGIWQTVWLEPAPRDHITRLDVAAGSDGAVNVTVFSSSNQSVPVEFSILQDGNVIATQEGTTGDPFDLSVDSPQLWSPDSPNLYNITVRLGDDVVESYTGFRTISSGIVDGVRRPLLNGEFVFQFGTLDQGYWPDGLYLAPNLEALVFDLQLLKSLGMNMVRKHIKVEPDLFYHACDTLGLLVIQDMPSMLVDGGEPNAEQQAEWERQLDILITEHKSYTCIVTWVIYNEGWGQIRSNYFPEFGLADRIRAQDPSRLIDATSGWHDHGAGDFSDNHHYATPQCGAPFYSTPSAPYDPNRIGIQGEFGGIGHNVSIENLWNVQQAIDTINQTYEISADLSAYNYRARVLFNELEDQVRMFACSAAVWTQTSDVEGEVNGLVTYDRRIERVDRNQWQSDIQALYDAAAGRGGAGGNSSRVAMPQYV

SEQ ID NO: 340 - DNA, 3754 bp, M. phaseolina
taccccgctccatggacagtgagccgataagtgctcgggcaactttgtcgcggattaccgacaactccgcagcggtgaataaaactccaggtcggatttcccggggcgtgactgtggtcaggagaggttccgtgtctcgcttcatcagccatgccgtctcaggccgagtccttctcttcgcctccggactggtgcaacctggacatcatccaccgcaacaccctcgcgccccgagccgccttcttcaactattcgtctccatctgccgcactcttgtatgatccgcagacatcggaatacgtgaagagcctgaacggacaatggaagttcagctacgccgtcaatccctaccgtgctccagacgggttcgagcagccagcgtttgatgcatcagcgtggcccgagatacccgttccctcgcactggcagttggaagggtatggaaagccccattacacaaacctgccatacccgttcccggtggacccgccacacgttccgctggatgaaaatccgaccggtagctatctgcggaagttcacggtgccgaacggattccgcgacaaacaagtgcggctccggtttgaaggcgtggattcggcattccatgtctgggtgaacggccgagagttaggctactcgcaaggcgccaggaatccatctgagtttgacgtaactccgttcgtaattttctccggggaaaacacggtcgccgtgagagtataccagtggtccgacggctcatatctcgaagatcaaggtgagcatgtggtttccatggactgaactgagcatcgctgatgtccacagaccaatggtggctcagcggcatttttcgtgacgtcaacctgatcgcgtttccgaaatctcacattcaggatttctttgtcaagactctgttagacgagaactacgagaacgcagtcctccgggtagacctcacgatagagggaggcggagcggtgaccctccagcttcttcagaatgacaagtccaccaaggtcctggagtcctcgggcgcgccttctggagatggtaccctcacgttggaattaccgcttgagaaccctcgcaaatggacggcggaagatccttacctctatcaccttgttatccagctcggcgatcagacaattgcgcatagggttggatttcgcagggcagaaatcaagaatggaattttcttggtcaacggcgcgaggattgtgttccggggagtcaaccggcatgaacatcacccaacgaaaggaagggcggtcggccccgagctgttacggcatgacctccttctcatgaagaaacacaacatcaacgccatccggacgtcccaccaaccaaatgatacccgtctctatgagctagcggatgagctggggttctggataatggacggtaagcagatctttttaaggagtaaaaagtgaagtacgcatctgtttgatcagtattcacccagcggatccaaggcagggtactctcagtgaccgtggggatttgagtcagttggaattgtcccttaggccttttagcattcatgtccgggcgacttcttcagctctccactgactacagagatcatctgttctccgcacatttgagtgtggtgtcgggcttttactccgctcgaatgcttccagacccgtatactaacagtagagcagaagcggacctcgagacccacggctttgcatgcgtagaagaggcagcgctatcaccagaggacaagaagaagccgtacgaggagagaaagttgatcacctacgaagcggctgcccgctggacttccgacaatccggtatgggaaaaggcttacgtggaccgcatgcagcaaatggtggcgcgagacaagaatcatccgtcgattgtcatgtggagcctgggcaatgaggccttctacggatgcaatcaccaggcgatgtacgactgggggaagaggtacgacccggacagggttatccattacgaaggcgacatccacgctaaaaccgtcgacttgttctcattgatgtatccggagctggacacgctccgggattttgcagagaaatgggacggcgcgaagccgctggtcctttgcgaatttgcgcatgccatgggcaacgggcctggtgctttgaaagagtacgtcgagctgttctacaagcatcggtgcttgcagggtggctgggtgtgggaatgggcaaatcatggccttgaacatactagtccggacagaaagaagtactacgcctatggcggtgattttggagacgaaccaaatgacgggacgttcgtgatggatggcctggtacgctcagaccacagcattgggccaggtctggtagaatacaagaaagcaatcgagccagtccagctcgtctcagggagcattgaagatggctacgtggctgtcgtcaatcggtacgacttctccaccttggaccacctggaatgccacctgtctgtagtcggggacgggttcaagcggcattttggaaaggttgaaataccaagtattcagcccggacaagaagcgaaattatcgattccggtgatgaccctctcggaacttccggacgggtcctacgcacaacttgactggaccttaaagagttcgaccgcgtgggctgctgcagggcacgaggtcacctcccagcaatttctcattaagccttacgctgacagaactccgttgaaatcttcgactgcccggaagataagcatatccgagcaatcatcagcggatctcaaaattcaaggaccaaaatccgggtggcatttcgatctgacgaagggactgttgacatcctggatcaagggctcgcacgaaatactccacagcagccctattttatccttccatcgggcacccactgataacgatggcagtatagctgctgattgggacgaaaagctccttccgcttgcgcgcccccactgccgctcggtaagttggagacatgacgaaacagccaacactgtgacggtggcgacggagcaccggattgcaccaccgatcttggaatgggcggtcaccgcacaaacagagtacgtcttctacggcactgaagacggcggggacgctgtgcgtatttcgatttccgccaaagcgtctggcaagaacctcccatccacctttgcccgcattggccttgagtttgctatctcttcatcgttccagaacggccagtggttcgggcgcgggcctggggagagctatcgggacaagaaggagtcacaacgggtgggaaactgggagatgcctattgatagcctctggacggaatatgaagttccacaggaagggggcaacagaacagatgtaaggtgggtcgagttctccggctttgcgccggaaacagagattcctatttcgttgcatgcatcgttcgttgggctgcctcagggcgggaacttcacggccagccattttgcaacgaaagatgtggctgaagccgctcatccttaccagcttcataggaacaggagagaggaggtctttgtcaggcttgacatggatcatcaagggcttggcactgagtcttgtgggccgggtgcattgccgcagtattccttgatcgtggaggagggattgcaatggaactggggagtgattttatcctgagagccatctctcgaatcgcgatcaatatgcagctagtgagctgtccaccgactgccttggtacatacattaccatcaatttctggccaaggcgttaaaaacattaagaactcgtgatctgttcaagagtcctccggattagagattgccc

SEQ ID NO: 341 - DNA, 3135 bp, M. phaseolina
atgccgtctcaggccgagtccttctcttcgcctccggactggtgcaacctggacatcatccaccgcaacaccctcgcgccccgagccgccttcttcaactattcgtctccatctgccgcactcttgtatgatccgcagacatcggaatacgtgaagagcctgaacggacaatggaagttcagctacgccgtcaatccctaccgtgctccagacgggttcgagcagccagcgtttgatgcatcagcgtggcccgagatacccgttccctcgcactggcagttggaagggtatggaaagccccattacacaaacctgccatacccgttcccggtggacccgccacacgttccgctggatgaaaatccgaccggtagctatctgcggaagttcacggtgccgaacggattccgcgacaaacaagtgcggctccggtttgaaggcgtggattcggcattccatgtctgggtgaacggccgagagttaggctactcgcaaggcgccaggaatccatctgagtttgacgtaactccgttcgtaattttctccggggaaaacacggtcgccgtgagagtataccagtggtccgacggctcatatctcgaagatcaagaccaatggtggctcagcggcatttttcgtgacgtcaacctgatcgcgtttccgaaatctcacattcaggatttctttgtcaagactctgttagacgagaactacgagaacgcagtcctccgggtagacctcacgatagagggaggcggagcggtgaccctccagcttcttcagaatgacaagtccaccaaggtcctggagtcctcgggcgcgccttctggagatggtaccctcacgttggaattaccgcttgagaaccctcgcaaatggacggcggaagatccttacctctatcaccttgttatccagctcggcgatcagacaattgcgcatagggttggatttcgcagggcagaaatcaagaatggaattttcttggtcaacggcgcgaggattgtgttccggggagtcaaccggcatgaacatcacccaacgaaaggaagggcggtcggccccgagctgttacggcatgacctccttctcatgaagaaacacaacatcaacgccatccggacgtcccaccaaccaaatgatacccgtctctatgagctagcggatgagctggggttctggataatggacgaagcggacctcgagacccacggctttgcatgcgtagaagaggcagcgctatcaccagaggacaagaagaagccgtacgaggagagaaagttgatcacctacgaagcggctgcccgctggacttccgacaatccggtatgggaaaaggcttacgtggaccgcatgcagcaaatggtggcgcgagacaagaatcatccgtcgattgtcatgtggagcctgggcaatgaggccttctacggatgcaatcaccaggcgatgtacgactgggggaagaggtacgacccggacagggttatccattacgaaggcgacatccacgctaaaaccgtcgacttgttctcattgatgtatccggagctggacacgctccgggattttgcagagaaatgggacggcgcgaagccgctggtcctttgcgaatttgcgcatgccatgggcaacgggcctggtgctttgaaagagtacgtcgagctgttctacaagcatcggtgcttgcagggtggctgggtgtgggaatgggcaaatcatggccttgaacatactagtccggacagaaagaagtactacgcctatggcggtgattttggagacgaaccaaatgacgggacgttcgtgatggatggcctggtacgctcagaccacagcattgggccaggtctggtagaatacaagaaagcaatcgagccagtccagctcgtctcagggagcattgaagatggctacgtggctgtcgtcaatcggtacgacttctccaccttggaccacctggaatgccacctgtctgtagtcggggacgggttcaagcggcattttggaaaggttgaaataccaagtattcagcccggacaagaagcgaaattatcgattccggtgatgaccctctcggaacttccggacgggtcctacgcacaacttgactggaccttaaagagttcgaccgcgtgggctgctgcagggcacgaggtcacctcccagcaatttctcattaagccttacgctgacagaactccgttgaaatcttcgactgcccggaagataagcatatccgagcaatcatcagcggatctcaaaattcaaggaccaaaatccgggtggcatttcgatctgacgaagggactgttgacatcctggatcaagggctcgcacgaaatactccacagcagccctattttatccttccatcgggcacccactgataacgatggcagtatagctgctgattgggacgaaaagctccttccgcttgcgcgcccccactgccgctcggtaagttggagacatgacgaaacagccaacactgtgacggtggcgacggagcaccggattgcaccaccgatcttggaatgggcggtcaccgcacaaacagagtacgtcttctacggcactgaagacggcggggacgctgtgcgtatttcgatttccgccaaagcgtctggcaagaacctcccatccacctttgcccgcattggccttgagtttgctatctcttcatcgttccagaacggccagtggttcgggcgcgggcctggggagagctatcgggacaagaaggagtcacaacgggtgggaaactgggagatgcctattgatagcctctggacggaatatgaagttccacaggaagggggcaacagaacagatgtaaggtgggtcgagttctccggctttgcgccggaaacagagattcctatttcgttgcatgcatcgttcgttgggctgcctcagggcgggaacttcacggccagccattttgcaacgaaagatgtggctgaagccgctcatccttaccagcttcataggaacaggagagaggaggtctttgtcaggcttgacatggatcatcaagggcttggcactgagtcttgtgggccgggtgcattgccgcagtattccttgatcgtggaggagggattgcaatggaactggggagtgattttatcctga

SEQ ID NO: 342 - protein, 1044 aa, M. phaseolina
MPSQAESFSSPPDWCNLDIIHRNTLAPRAAFFNYSSPSAALLYDPQTSEYVKSLNGQWKFSYAVNPYRAPDGFEQPAFDASAWPEIPVPSHWQLEGYGKPHYTNLPYPFPVDPPHVPLDENPTGSYLRKFTVPNGFRDKQVRLRFEGVDSAFHVWVNGRELGYSQGARNPSEFDVTPFVIFSGENTVAVRVYQWSDGSYLEDQDQWWLSGIFRDVNLIAFPKSHIQDFFVKTLLDENYENAVLRVDLTIEGGGAVTLQLLQNDKSTKVLESSGAPSGDGTLTLELPLENPRKWTAEDPYLYHLVIQLGDQTIAHRVGFRRAEIKNGIFLVNGARIVFRGVNRHEHHPTKGRAVGPELLRHDLLLMKKHNINAIRTSHQPNDTRLYELADELGFWIMDEADLETHGFACVEEAALSPEDKKKPYEERKLITYEAAARWTSDNPVWEKAYVDRMQQMVARDKNHPSIVMWSLGNEAFYGCNHQAMYDWGKRYDPDRVIHYEGDIHAKTVDLFSLMYPELDTLRDFAEKWDGAKPLVLCEFAHAMGNGPGALKEYVELFYKHRCLQGGWVWEWANHGLEHTSPDRKKYYAYGGDFGDEPNDGTFVMDGLVRSDHSIGPGLVEYKKAIEPVQLVSGSIEDGYVAVVNRYDFSTLDHLECHLSVVGDGFKRHFGKVEIPSIQPGQEAKLSIPVMTLSELPDGSYAQLDWTLKSSTAWAAAGHEVTSQQFLIKPYADRTPLKSSTARKISISEQSSADLKIQGPKSGWHFDLTKGLLTSWIKGSHEILHSSPILSFHRAPTDNDGSIAADWDEKLLPLARPHCRSVSWRHDETANTVTVATEHRIAPPILEWAVTAQTEYVFYGTEDGGDAVRISISAKASGKNLPSTFARIGLEFAISSSFQNGQWFGRGPGESYRDKKESQRVGNWEMPIDSLWTEYEVPQEGGNRTDVRWVEFSGFAPETEIPISLHASFVGLPQGGNFTASHFATKDVAEAAHPYQLHRNRREEVFVRLDMDHQGLGTESCGPGALPQYSLIVEEGLQWNWGVILS

SEQ ID NO: 343 - DNA, 2473 bp, M. phaseolina
ccgctatgtcccatgcgatccatgaggccaagagacggtaatagcgttatgccccacctttcccgctgaggacatgtgtacctaaactatttacacgacctccccatccgctccttcaatccgccactccatccatcgttttgagcaaccatggctgctgacgcttatccccgtcctgatttccagcgtactagtctccattggcagtctctcaatggcccttgggatttcattttcgatgatgacgatgtcggcctgtccgagcaatggcagctcaaaggcctccctgaaagcgtcactgtcactggtgctgcatcttccaagccagcttacgagtctgagaacgaatcaatcaccgccaagattgctgccaacacccagaacttgatcaaggataacctggccttccggtcatctagctccaccaccaacaagaagcgtcagattcaggttccctacgtcttccagtgcccggcctccggcatcaacgagcgcggtgaccatgaagtcctttggtaccaacgtcccctttctgatccccgctccgccgagcagaagaacaggcgcgaccgggtcatcctcaggttcggtgcagtcgattatgacgccaaggtctggctggatggtcactttgtcgggggccaccgcgggggtcacgtacctttcgaactggacatcaccgactctttggactcgagtccgcctgagcccttgaggctaacactccgcgtctatgattccgcgtacgacttgacgcaaccccgcggaaaacaatactggggcgctaaaccggagagtatattctacactccttctggcggcatctggcagcctgtctggctcgagactgtcccatctgccagattggcggatagcagctttggtaccgtcttacgctccaacgacattgagagcggagaccttcatgcccatattgcgttgctaggtcgcaaggtcggccataagtacagcatcgaggttgaggcaagttttgcgggcattcccgtcgccaaatcacccaagaaggatcttccaaaggacaagaatcacgtgaagctggatctgaacctgcgtctgtctcaggagcaactgtctagtctccccgatgcagtgcgcgaagcagcaccactgggaaacgaccgatgttggcggaacagcctggcactgtggtcacccgactttcctcaactgtacgacttgaaactgcggctttttgacgtctcgggtaagcttctggatgaagtgaagactaccactgggatgcgttctttgaactggacgcgtggggatggtgcactgcatctcaacgaccggccgatcttccaagcgatggtgcttgaccagggatactggcctgagactttcatgacaccgccctctcaggagcatcttaaagcggacattgaactcaccaagaggatgggtttcaatggttgtaggaaacaccagaaggtggaagatcctgtcttcctttactgggctgatagactcggcttcattgtatggggcgagatgggcaatgcctaccagttcagccaggagtatgtagagcgcttcaaccaggaatggattgaagcggtcaagagagacatcaaccatccatcaatcatcacttggaccccggttaatgaaagctgggcatacacatcccttaaagacaacattgaacagcggaaccacatccgagctctctactacctgaccaagtaagccagcagctaccatgtcgcaatacacacatgctgactcatttccaggactctcgatcccaccaggcccatcaatgacaactgcggttgggagcatgtgtgcactgacctcacgacttaccatgattacagtgacgcccctgctttggcagaaacctgctcgactctgcagggtatcttaggtccaaaggcaggccggcctatgttcgttgagcccattcaaggtttagatccgggtgcagagcatcgccctggagcagttgtgttgaacaccgagtttggaggcgtcaacattgctcctgccacaggcaattccgccgatgaatggggttacacgactgcaagcgatcccgatgacttgcttcagaggattgatcgtttgatgcgtgctgttgtccaaggcggccactctagtggttttgtatggactcaactgtaagtcgccgcagcattcatgagataatcagaggctaacaggtgtctccagggcggatatcgaacaagagaccaacggtctttactctttcgaccgcaaagaaaagcttagtgcagcgaaggtgaaaggcgtattggatgaagttctcagagtcttttacagcagcagaggcttctagcttagtaaccattgtcactcttaacgtagataagacgggaaattcaagatgtcggccgctacgtttcactgctctatttgaacgtatggtcaactgcaacatcaatcctattttcatagaatttgcggggcaaggatggtgggccacttg

SEQ ID NO: 344 - DNA, 2070 bp, M. phaseolina
atggctgctgacgcttatccccgtcctgatttccagcgtactagtctccattggcagtctctcaatggcccttgggatttcattttcgatgatgacgatgtcggcctgtccgagcaatggcagctcaaaggcctccctgaaagcgtcactgtcactggtgctgcatcttccaagccagcttacgagtctgagaacgaatcaatcaccgccaagattgctgccaacacccagaacttgatcaaggataacctggccttccggtcatctagctccaccaccaacaagaagcgtcagattcaggttccctacgtcttccagtgcccggcctccggcatcaacgagcgcggtgaccatgaagtcctttggtaccaacgtcccctttctgatccccgctccgccgagcagaagaacaggcgcgaccgggtcatcctcaggttcggtgcagtcgattatgacgccaaggtctggctggatggtcactttgtcgggggccaccgcgggggtcacgtacctttcgaactggacatcaccgactctttggactcgagtccgcctgagcccttgaggctaacactccgcgtctatgattccgcgtacgacttgacgcaaccccgcggaaaacaatactggggcgctaaaccggagagtatattctacactccttctggcggcatctggcagcctgtctggctcgagactgtcccatctgccagattggcggatagcagctttggtaccgtcttacgctccaacgacattgagagcggagaccttcatgcccatattgcgttgctaggtcgcaaggtcggccataagtacagcatcgaggttgaggcaagttttgcgggcattcccgtcgccaaatcacccaagaaggatcttccaaaggacaagaatcacgtgaagctggatctgaacctgcgtctgtctcaggagcaactgtctagtctccccgatgcagtgcgcgaagcagcaccactgggaaacgaccgatgttggcggaacagcctggcactgtggtcacccgactttcctcaactgtacgacttgaaactgcggctttttgacgtctcgggtaagcttctggatgaagtgaagactaccactgggatgcgttctttgaactggacgcgtggggatggtgcactgcatctcaacgaccggccgatcttccaagcgatggtgcttgaccagggatactggcctgagactttcatgacaccgccctctcaggagcatcttaaagcggacattgaactcaccaagaggatgggtttcaatggttgtaggaaacaccagaaggtggaagatcctgtcttcctttactgggctgatagactcggcttcattgtatggggcgagatgggcaatgcctaccagttcagccaggagtatgtagagcgcttcaaccaggaatggattgaagcggtcaagagagacatcaaccatccatcaatcatcacttggaccccggttaatgaaagctgggcatacacatcccttaaagacaacattgaacagcggaaccacatccgagctctctactacctgaccaagactctcgatcccaccaggcccatcaatgacaactgcggttgggagcatgtgtgcactgacctcacgacttaccatgattacagtgacgcccctgctttggcagaaacctgctcgactctgcagggtatcttaggtccaaaggcaggccggcctatgttcgttgagcccattcaaggtttagatccgggtgcagagcatcgccctggagcagttgtgttgaacaccgagtttggaggcgtcaacattgctcctgccacaggcaattccgccgatgaatggggttacacgactgcaagcgatcccgatgacttgcttcagaggattgatcgtttgatgcgtgctgttgtccaaggcggccactctagtggttttgtatggactcaactggcggatatcgaacaagagaccaacggtctttactctttcgaccgcaaagaaaagcttagtgcagcgaaggtgaaaggcgtattggatgaagttctcagagtcttttacagcagcagaggcttctag

SEQ ID NO: 345 - protein, 689 aa, M. phaseolina
MAADAYPRPDFQRTSLHWQSLNGPWDFIFDDDDVGLSEQWQLKGLPESVTVTGAASSKPAYESENESITAKIAANTQNLIKDNLAFRSSSSTTNKKRQIQVPYVFQCPASGINERGDHEVLWYQRPLSDPRSAEQKNRRDRVILRFGAVDYDAKVWLDGHFVGGHRGGHVPFELDITDSLDSSPPEPLRLTLRVYDSAYDLTQPRGKQYWGAKPESIFYTPSGGIWQPVWLETVPSARLADSSFGTVLRSNDIESGDLHAHIALLGRKVGHKYSIEVEASFAGIPVAKSPKKDLPKDKNHVKLDLNLRLSQEQLSSLPDAVREAAPLGNDRCWRNSLALWSPDFPQLYDLKLRLFDVSGKLLDEVKTTTGMRSLNWTRGDGALHLNDRPIFQAMVLDQGYWPETFMTPPSQEHLKADIELTKRMGFNGCRKHQKVEDPVFLYWADRLGFIVWGEMGNAYQFSQEYVERFNQEWIEAVKRDINHPSIITWTPVNESWAYTSLKDNIEQRNHIRALYYLTKTLDPTRPINDNCGWEHVCTDLTTYHDYSDAPALAETCSTLQGILGPKAGRPMFVEPIQGLDPGAEHRPGAVVLNTEFGGVNIAPATGNSADEWGYTTASDPDDLLQRIDRLMRAVVQGGHSSGFVWTQLADIEQETNGLYSFDRKEKLSAAKVKGVLDEVLRVFYSSRGF

SEQ ID NO: 346 - DNA, 3651 bp, M. phaseolina
tggtagctttttttctcccccggaatctccggtccagcagctctacttttcccgctcgtcgaggaagtaagctctgctgttgctgcgtcgtctttttgctctccgcactgcgttttgaagcttcgtccgtcattgtcgaagcttgagaccatgaagctcaccagcagcttgctggccgccggcctggcgtcccaggcgctaggttacgtcgttggcggtaagccaaaggacttgatcaagccatacaagcgtgaggctctgcaggatattgtgtgtctttctccttatctttggagctagcggctcgtccgggaaacaagctcactgacttgccgggaacaggtcacttgggacgagcactcgctgtttgtcaacggcgagcgtatcatcttccttagcggcgaataccacccgttcaggtacgattgaccccacacactgtctcaatggccggccactggacctcagttctgacgcccaaaaatccagacttcccgtcccctcgctgtggcttgacgttttccacaagatcaaggcgctcggtttcaacggcgtgtccttctatgttgactgggctttgctggagggcactcctggcgagttcactgccgagggtgtgttcgcttgggagccctttttcgacgccgcgcaagaggccggaatctatcttctcgctgtgagccaccctcagtggattctctactgactcatgctaatcgtatgaagcgccctggcccatacatcaacgctgaggtctccggtggtggcttccctggttggctccagcgtgtcaacggcaccctgaggacggacgaccccggctacatcaatgccactgacaagtatgtgacccatgctctcaacgctatttggtccttggcccacctaacataaccttcttagctacgcccgctcgatcggagagattatcgccaaggcccagatcaccaacggcggccccgtcattctcttccaacccgagaacgagtacaccggtgccaccgacaacgtcgaattccccaacgagaactattgggctatcgttgagaagcagttcagggacgcaggtatcgttgtgccatacatcaataacgatgcctctccccaaggatacttcgcccctggctccaactggactcctcaggtcgatatttacggccatgatggatacccgctcggattcgattgcgccaatccttacacttggcctgatggcaagctgcccactaactggaaaactctccatgaacagcaaagcccgagcacgccttactctgtcatcgaggtaagctcgagctcttgaatgatgtcggatatagctgacacaatggacagttccaaggtggtgcctttgacccctggggtggtcttggttttgaccagtgctctgttctgctcaaccacgagttcgaacgtgtcttctacaagaacctccagagctttggtgttactatcctgaacctctacatggtgagacgagaaaaccctattttacaattcgactcagttctaatcgtcatgcagattttcggtggaaccaactggggtaatctcggccaccccggcggctacacttcttacgactacggctcagtcatcagggagactcgtgagattaaccgcgagaagtacagcgagttgaagcttcagggcaactttctgaaggtgtctcccgcctacttgactgctgagcctggtgacctttccaacggttcctacgccgacacttctgacattgctgtcacgcccctcctgggcaacaccaccaacttcttcgttgtcagacatgctgcctacaactccttggagtcgactccctacaccatcacactaccaaccagcgctggagatcttaccatcccgcagctgaacggcaccctgaccctgaatggccgcgattccaaggtccacgtcaccgactacgacgtgggtggtgagaatctcctttactctaccgctgagatcttcacttggaaggcctacgatgacaagaccgtgctggtcgtctacggaggtcctggcgagtctcacgagctcgccttctccagcggcaagaacgctaccatcgttgagggctctggtgtgactatcgcacctaagggcggtgccactctcctacactggtctgtcacgccgacgcgcaaggtcgtcaaggtgggagagagcctgtacgtctatattctcgaccgcaactctgcctacaactattggacccacgacgacattgtcctcaaggctggttacctcatccgcaacgccaccgtcgatggcactacgctctccgttgtcggtgatctcaacgctactaccaccctcgaggttattggcggcgctccttctggtctaaccaagctcaccttcaacggtgaggatgttgccttcaaccagtcctctttgggcaatgtcgccgcaactctgcagtacactcctccggcaattagcctccctgacctgtcctccctctcctggaagagcatcgattctctcccagagatccagactgactacgacgactcggcctggcccgccgccgacttgcctactacctacaatacccttcgtcccattaccacgccgaccagcctctacggcagtgactacggttaccactatggtaccctcctcttccgtggtcacttcaccgccaccggctctgagacttcgttgtctatctccgcgcagggtggctttgcctcgggtttcaccgtcttcctgaacagtgtcgcccttggctcgtggaagggtgctgactacgcctcaaatggcaacttgaccctctctatcccctcgtccgccgttcccacgagtggctctgaagccgtcatcaccgtcgttctcgacacaaccggaatcagcgagaactgggtcactggcgccgaagaagctaagctcccgcgcggcatcctcaattacgacctcgccggccacgacgcaagcgatgtcacctggaagctgaccggcaacctcggcggcgagaagtacatcgacaagtcgcgcggcccgctgaacgagggcggtctctttgccgagcgccagggctaccacctccccggcgcgcccaccgacgactggtccgccagcgagggtcccgccgctgacggtgtcgagggcgtcggagtcaagtggtacgccaccaccatcgacctcgacatcccgaccggctgggatgtgcccatcagcttctccttcgccaactctactagcaacgcaaccgacgccgacggcctcgccaaggcataccgcgtacagctgttcgtcaacggctggcagtttggcaagtacgtccacaacatcggcccccaggacgtcttccccgtccccgagggcatctgggactacaggggcagcaactacgtcgctgtcagcttgttcagccaagaggagagcggcgccacggttgatgggttcgaattggtgcatgggacgcccgtcaagaccgggtaccaggcggttgaggttgtgcaaggtgagacgtttgcggagcgtgcgggggcgtactgacgggagccgagtgatgaggagatgtggttgggagatggagagctgagatgattgaaagtccatcttcttgagatatgagttaatgatatgattctgtcatgaatgaatggtccatccaaacgcatccagccagactaaatgcacacatgc

SEQ ID NO: 347 - DNA, 2994 bp, M. phaseolina
atgaagctcaccagcagcttgctggccgccggcctggcgtcccaggcgctaggttacgtcgttggcggtaagccaaaggacttgatcaagccatacaagcgtgaggctctgcaggatattgtcacttgggacgagcactcgctgtttgtcaacggcgagcgtatcatcttccttagcggcgaataccacccgttcagacttcccgtcccctcgctgtggcttgacgttttccacaagatcaaggcgctcggtttcaacggcgtgtccttctatgttgactgggctttgctggagggcactcctggcgagttcactgccgagggtgtgttcgcttgggagccctttttcgacgccgcgcaagaggccggaatctatcttctcgctcgccctggcccatacatcaacgctgaggtctccggtggtggcttccctggttggctccagcgtgtcaacggcaccctgaggacggacgaccccggctacatcaatgccactgacaactacgcccgctcgatcggagagattatcgccaaggcccagatcaccaacggcggccccgtcattctcttccaacccgagaacgagtacaccggtgccaccgacaacgtcgaattccccaacgagaactattgggctatcgttgagaagcagttcagggacgcaggtatcgttgtgccatacatcaataacgatgcctctccccaaggatacttcgcccctggctccaactggactcctcaggtcgatatttacggccatgatggatacccgctcggattcgattgcgccaatccttacacttggcctgatggcaagctgcccactaactggaaaactctccatgaacagcaaagcccgagcacgccttactctgtcatcgagttccaaggtggtgcctttgacccctggggtggtcttggttttgaccagtgctctgttctgctcaaccacgagttcgaacgtgtcttctacaagaacctccagagctttggtgttactatcctgaacctctacatgattttcggtggaaccaactggggtaatctcggccaccccggcggctacacttcttacgactacggctcagtcatcagggagactcgtgagattaaccgcgagaagtacagcgagttgaagcttcagggcaactttctgaaggtgtctcccgcctacttgactgctgagcctggtgacctttccaacggttcctacgccgacacttctgacattgctgtcacgcccctcctgggcaacaccaccaacttcttcgttgtcagacatgctgcctacaactccttggagtcgactccctacaccatcacactaccaaccagcgctggagatcttaccatcccgcagctgaacggcaccctgaccctgaatggccgcgattccaaggtccacgtcaccgactacgacgtgggtggtgagaatctcctttactctaccgctgagatcttcacttggaaggcctacgatgacaagaccgtgctggtcgtctacggaggtcctggcgagtctcacgagctcgccttctccagcggcaagaacgctaccatcgttgagggctctggtgtgactatcgcacctaagggcggtgccactctcctacactggtctgtcacgccgacgcgcaaggtcgtcaaggtgggagagagcctgtacgtctatattctcgaccgcaactctgcctacaactattggacccacgacgacattgtcctcaaggctggttacctcatccgcaacgccaccgtcgatggcactacgctctccgttgtcggtgatctcaacgctactaccaccctcgaggttattggcggcgctccttctggtctaaccaagctcaccttcaacggtgaggatgttgccttcaaccagtcctctttgggcaatgtcgccgcaactctgcagtacactcctccggcaattagcctccctgacctgtcctccctctcctggaagagcatcgattctctcccagagatccagactgactacgacgactcggcctggcccgccgccgacttgcctactacctacaatacccttcgtcccattaccacgccgaccagcctctacggcagtgactacggttaccactatggtaccctcctcttccgtggtcacttcaccgccaccggctctgagacttcgttgtctatctccgcgcagggtggctttgcctcgggtttcaccgtcttcctgaacagtgtcgcccttggctcgtggaagggtgctgactacgcctcaaatggcaacttgaccctctctatcccctcgtccgccgttcccacgagtggctctgaagccgtcatcaccgtcgttctcgacacaaccggaatcagcgagaactgggtcactggcgccgaagaagctaagctcccgcgcggcatcctcaattacgacctcgccggccacgacgcaagcgatgtcacctggaagctgaccggcaacctcggcggcgagaagtacatcgacaagtcgcgcggcccgctgaacgagggcggtctctttgccgagcgccagggctaccacctccccggcgcgcccaccgacgactggtccgccagcgagggtcccgccgctgacggtgtcgagggcgtcggagtcaagtggtacgccaccaccatcgacctcgacatcccgaccggctgggatgtgcccatcagcttctccttcgccaactctactagcaacgcaaccgacgccgacggcctcgccaaggcataccgcgtacagctgttcgtcaacggctggcagtttggcaagtacgtccacaacatcggcccccaggacgtcttccccgtccccgagggcatctgggactacaggggcagcaactacgtcgctgtcagcttgttcagccaagaggagagcggcgccacggttgatgggttcgaattggtgcatgggacgcccgtcaagaccgggtaccaggcggttgaggttgtgcaaggtgagacgtttgcggagcgtgcgggggcgtactga

SEQ ID NO: 348 - protein, 997 aa, M. phaseolina
MKLTSSLLAAGLASQALGYVVGGKPKDLIKPYKREALQDIVTWDEHSLFVNGERIIFLSGEYHPFRLPVPSLWLDVFHKIKALGFNGVSFYVDWALLEGTPGEFTAEGVFAWEPFFDAAQEAGIYLLARPGPYINAEVSGGGFPGWLQRVNGTLRTDDPGYINATDNYARSIGEIIAKAQITNGGPVILFQPENEYTGATDNVEFPNENYWAIVEKQFRDAGIVVPYINNDASPQGYFAPGSNWTPQVDIYGHDGYPLGFDCANPYTWPDGKLPTNWKTLHEQQSPSTPYSVIEFQGGAFDPWGGLGFDQCSVLLNHEFERVFYKNLQSFGVTILNLYMIFGGTNWGNLGHPGGYTSYDYGSVIRETREINREKYSELKLQGNFLKVSPAYLTAEPGDLSNGSYADTSDIAVTPLLGNTTNFFVVRHAAYNSLESTPYTITLPTSAGDLTIPQLNGTLTLNGRDSKVHVTDYDVGGENLLYSTAEIFTWKAYDDKTVLVVYGGPGESHELAFSSGKNATIVEGSGVTIAPKGGATLLHWSVTPTRKVVKVGESLYVYILDRNSAYNYWTHDDIVLKAGYLIRNATVDGTTLSVVGDLNATTTLEVIGGAPSGLTKLTFNGEDVAFNQSSLGNVAATLQYTPPAISLPDLSSLSWKSIDSLPEIQTDYDDSAWPAADLPTTYNTLRPITTPTSLYGSDYGYHYGTLLFRGHFTATGSETSLSISAQGGFASGFTVFLNSVALGSWKGADYASNGNLTLSIPSSAVPTSGSEAVITVVLDTTGISENWVTGAEEAKLPRGILNYDLAGHDASDVTWKLTGNLGGEKYIDKSRGPLNEGGLFAERQGYHLPGAPTDDWSASEGPAADGVEGVGVKWYATTIDLDIPTGWDVPISFSFANSTSNATDADGLAKAYRVQLFVNGWQFGKYVHNIGPQDVFPVPEGIWDYRGSNYVAVSLFSQEESGATVDGFELVHGTPVKTGYQAVEVVQGETFAERAGAY

SEQ ID NO: 349 - DNA, 3452 bp, M. phaseolina
ccaggccctttgattgatggatcttgtgcctggccatggcccgcataccgtatttttgtatgacttcatgggctgtggttccattaagtatacgctgatggaaggcgtacttcgccgctccctgctccttcatctccttcaccggcagccatgcgcgcccttacggctctgctgctcctcctgggcgcagttacctccctcgtttgcgcgcagagagacaatggttacagcgacgttgtccagtgggacgaaaacagcttgttcatcaatggcgagcgcgtctatatctactccggcgagttccactacgcccgtcttccggtgccggaattgtggcgtgatattatacagaagtacaaggcaaacggcttgaacaccctcaggtacgctcgactccccagtaatcccgcctcgccatactgatcctcgtagcatctacttcttctggtcgtaccactcgccttccaagggtgttttcgacttcgaatctcccggcaaagacatccagaagctctttgacatcgcgaaggaagagggagtctacattatcgctcgccccggcccttactgcaacgcggagaccagcgctggtggatacggactttatctcacagacggcagcggcggcgacgtccgaaccaacgacgagacataccacgagcaatggctgccctggatcaacgccgttctaccgatcatcgctcgcaaccaaatcaccgagggtggacctgtcattcttgtccaagtcgagaacgagctgacgcaatcacgtcatgtggccaccgaccctctggtcttatacatggagcagctcaagaaggccttcagagacaacggcatagtcgtccctttcacatcgaacgagaagggcatgcgcggtcagagttggtcaaccgactaccagaatgtgggcggagctgtggatatctatggtctcgacagctatgccggtggcctcagctgctcgaatatcgatactggatttaccatcgtccgcacttactatcaatggttccagaactactcatacacgcagcctgagttcactcctgaattcaaaggtggctggttccagccatggggcggctacttcttcgacgactgcatctcggagcatgacacggcttatccggatgtgttctacaagaacaacatagcccagaggctgacgcttcagaacatgtatatgacatatggaggaacgaattggggccacctcgcagcgccagtggtattttgggatcctgtcacaccgaatttttatctatggaggactgacgacgattaggtatacacttcgtacgactacggagcaccgctcagagagacgcgcgaaatctgggacaagttcaagcatatcaagctcatcagcttgttcactagggtcagcgagggtcttctcaacaccgacatggaaagtaacggcaccggaaacgccgtcaacacttcgtcgattttcacttgggtccttcgcaatcccgagacctcggcaggcttctacgttacgcaacacgacaactccaggtctcgcgagaacacccctttctctttgaacctcgccacgtccgagggcgcagttactgtaccgagtcttgatttgcgcggccgtcaaagcaggatagtggttaccgattaccctgtcggggattacacacttttgtactcatctgccgaggtcttgacctacggagtgtttgacgtgcctgttatcgtcttctacctcaacagaggccaagtgggagagcttgccttcaagggaggcctcaagaacacaaacttcaccacctacggcgctgagacggacttcactgccaccgccgccggcaacgacacgtccgcagccttcaagtacactcagtccgagggcgccaccgtcatcaaattcgccaacggaccggtgctatacctcctcgaaagatgggccgcatacaccttcttcgcgccagccatgacctcgaacccgcacatcgccgccgacgagcagatcttcgtgcttgggccctacctcgtccgcagcgccagcgtcaccggcagcaccgtctccatatcgggcgaccacctcaacgacaccagcatcgacgtctacgtcggcgacccctccgtcaccagcatcagctggaacggcgccgcgctcgcgacgacgcgctctgcctacggctcgctgcaggcttcgctgccgggcatcctcgaccgcgtcgtcgcgctgcccgctctgacgggctggagggtcgccgacgccctgcctgaggccgacccggcctatgacgactcgcgctggaccgtcgccaacaagacaaccaccctcagcccgctcgcgccgctcacgctgcccgtgctgtacggcgccgactacggcttctacgccggcgtcctgctgtaccgcggccactttgctggagctggcgcgactggcgcgaacgtcaccgtgcaaggcggcgtcgcggcggggtggtcggcatggctgaatggcaagctggtcggcggccaccccggcaacgcgtcgctgctccagacgtccgtcgtgctggacttcgccggcgccgagctgagagaggagggaaatgttttgactgtggtgacggactatactgggcacgaccaggacagccagggaccctacggcccgctaaacccccggggcatcctgggcgcgaagctgatcggcacgagcaacgccacgaattcgagtgcgccggtgttcgagcagtggaagattcaggggaatgcgggaggtggcgcgggatatatcgatccggtgcgtgggccgatgaatgagggtggactgcatggcgagcggttgggatggcatttgcctgggttcgataccgcgcagtgggaggagggcgatccactcgaggggttcaagggcgcaggcatcaaatggtacaggacggagtttgacctcgatgtggacgaggacctggatgcgccgattgggctggaagtgagcattccggatgggacagtggcgagggtgcagatcttcatcaatgggtgagtttggcttgcagcctcggtgttggcttttggagtcttttactgacggcatgaacagttaccagtatggcaagtatctgccgcatattggcccgcagacgaagtttcccttcccgcccggtgtgctgaacaaccgcggaacgaatagtctgtcactcagtgtttgggcgcagacggaagagggtgtcgcgttcgataaggtggatctcgtcttgtacgggaagtaccagtccgactttgggttttcgagggattggagcgcgctccagccgggctggtcggaggagcgcctgcagtatgcgtagagaaggagatactgcagagtttcgtacagtacatatatatgcggcttgggtgccttgttaaaaaaaatgaaaaaaaaaaataaggtcaatgaaaagggcaaagtgaaacccgctgcttcatctgatgcatgttggaaagaccagaccagc

SEQ ID NO: 350 - DNA, 2985 bp, M. phaseolina
atgcgcgcccttacggctctgctgctcctcctgggcgcagttacctccctcgtttgcgcgcagagagacaatggttacagcgacgttgtccagtgggacgaaaacagcttgttcatcaatggcgagcgcgtctatatctactccggcgagttccactacgcccgtcttccggtgccggaattgtggcgtgatattatacagaagtacaaggcaaacggcttgaacaccctcagcatctacttcttctggtcgtaccactcgccttccaagggtgttttcgacttcgaatctcccggcaaagacatccagaagctctttgacatcgcgaaggaagagggagtctacattatcgctcgccccggcccttactgcaacgcggagaccagcgctggtggatacggactttatctcacagacggcagcggcggcgacgtccgaaccaacgacgagacataccacgagcaatggctgccctggatcaacgccgttctaccgatcatcgctcgcaaccaaatcaccgagggtggacctgtcattcttgtccaagtcgagaacgagctgacgcaatcacgtcatgtggccaccgaccctctggtcttatacatggagcagctcaagaaggccttcagagacaacggcatagtcgtccctttcacatcgaacgagaagggcatgcgcggtcagagttggtcaaccgactaccagaatgtgggcggagctgtggatatctatggtctcgacagctatgccggtggcctcagctgctcgaatatcgatactggatttaccatcgtccgcacttactatcaatggttccagaactactcatacacgcagcctgagttcactcctgaattcaaaggtggctggttccagccatggggcggctacttcttcgacgactgcatctcggagcatgacacggcttatccggatgtgttctacaagaacaacatagcccagaggctgacgcttcagaacatgtatatgacatatggaggaacgaattggggccacctcgcagcgccagtggtatacacttcgtacgactacggagcaccgctcagagagacgcgcgaaatctgggacaagttcaagcatatcaagctcatcagcttgttcactagggtcagcgagggtcttctcaacaccgacatggaaagtaacggcaccggaaacgccgtcaacacttcgtcgattttcacttgggtccttcgcaatcccgagacctcggcaggcttctacgttacgcaacacgacaactccaggtctcgcgagaacacccctttctctttgaacctcgccacgtccgagggcgcagttactgtaccgagtcttgatttgcgcggccgtcaaagcaggatagtggttaccgattaccctgtcggggattacacacttttgtactcatctgccgaggtcttgacctacggagtgtttgacgtgcctgttatcgtcttctacctcaacagaggccaagtgggagagcttgccttcaagggaggcctcaagaacacaaacttcaccacctacggcgctgagacggacttcactgccaccgccgccggcaacgacacgtccgcagccttcaagtacactcagtccgagggcgccaccgtcatcaaattcgccaacggaccggtgctatacctcctcgaaagatgggccgcatacaccttcttcgcgccagccatgacctcgaacccgcacatcgccgccgacgagcagatcttcgtgcttgggccctacctcgtccgcagcgccagcgtcaccggcagcaccgtctccatatcgggcgaccacctcaacgacaccagcatcgacgtctacgtcggcgacccctccgtcaccagcatcagctggaacggcgccgcgctcgcgacgacgcgctctgcctacggctcgctgcaggcttcgctgccgggcatcctcgaccgcgtcgtcgcgctgcccgctctgacgggctggagggtcgccgacgccctgcctgaggccgacccggcctatgacgactcgcgctggaccgtcgccaacaagacaaccaccctcagcccgctcgcgccgctcacgctgcccgtgctgtacggcgccgactacggcttctacgccggcgtcctgctgtaccgcggccactttgctggagctggcgcgactggcgcgaacgtcaccgtgcaaggcggcgtcgcggcggggtggtcggcatggctgaatggcaagctggtcggcggccaccccggcaacgcgtcgctgctccagacgtccgtcgtgctggacttcgccggcgccgagctgagagaggagggaaatgttttgactgtggtgacggactatactgggcacgaccaggacagccagggaccctacggcccgctaaacccccggggcatcctgggcgcgaagctgatcggcacgagcaacgccacgaattcgagtgcgccggtgttcgagcagtggaagattcaggggaatgcgggaggtggcgcgggatatatcgatccggtgcgtgggccgatgaatgagggtggactgcatggcgagcggttgggatggcatttgcctgggttcgataccgcgcagtgggaggagggcgatccactcgaggggttcaagggcgcaggcatcaaatggtacaggacggagtttgacctcgatgtggacgaggacctggatgcgccgattgggctggaagtgagcattccggatgggacagtggcgagggtgcagatcttcatcaatggttaccagtatggcaagtatctgccgcatattggcccgcagacgaagtttcccttcccgcccggtgtgctgaacaaccgcggaacgaatagtctgtcactcagtgtttgggcgcagacggaagagggtgtcgcgttcgataaggtggatctcgtcttgtacgggaagtaccagtccgactttgggttttcgagggattggagcgcgctccagccgggctggtcggaggagcgcctgcagtatgcgtag

SEQ ID NO: 351 - protein, 994 aa, M. phaseolina
MRALTALLLLLGAVTSLVCAQRDNGYSDVVQWDENSLFINGERVYIYSGEFHYARLPVPELWRDIIQKYKANGLNTLSIYFFWSYHSPSKGVFDFESPGKDIQKLFDIAKEEGVYIIARPGPYCNAETSAGGYGLYLTDGSGGDVRTNDETYHEQWLPWINAVLPIIARNQITEGGPVILVQVENELTQSRHVATDPLVLYMEQLKKAFRDNGIVVPFTSNEKGMRGQSWSTDYQNVGGAVDIYGLDSYAGGLSCSNIDTGFTIVRTYYQWFQNYSYTQPEFTPEFKGGWFQPWGGYFFDDCISEHDTAYPDVFYKNNIAQRLTLQNMYMTYGGTNWGHLAAPVVYTSYDYGAPLRETREIWDKFKHIKLISLFTRVSEGLLNTDMESNGTGNAVNTSSIFTWVLRNPETSAGFYVTQHDNSRSRENTPFSLNLATSEGAVTVPSLDLRGRQSRIVVTDYPVGDYTLLYSSAEVLTYGVFDVPVIVFYLNRGQVGELAFKGGLKNTNFTTYGAETDFTATAAGNDTSAAFKYTQSEGATVIKFANGPVLYLLERWAAYTFFAPAMTSNPHIAADEQIFVLGPYLVRSASVTGSTVSISGDHLNDTSIDVYVGDPSVTSISWNGAALATTRSAYGSLQASLPGILDRVVALPALTGWRVADALPEADPAYDDSRWTVANKTTTLSPLAPLTLPVLYGADYGFYAGVLLYRGHFAGAGATGANVTVQGGVAAGWSAWLNGKLVGGHPGNASLLQTSVVLDFAGAELREEGNVLTVVTDYTGHDQDSQGPYGPLNPRGILGAKLIGTSNATNSSAPVFEQWKIQGNAGGGAGYIDPVRGPMNEGGLHGERLGWHLPGFDTAQWEEGDPLEGFKGAGIKWYRTEFDLDVDEDLDAPIGLEVSIPDGTVARVQIFINGYQYGKYLPHIGPQTKFPFPPGVLNNRGTNSLSLSVWAQTEEGVAFDKVDLVLYGKYQSDFGFSRDWSALQPGWSEERLQYA

SEQ ID NO: 352 - DNA, 1590 bp, M. phaseolina
tctccctgatttgctaacgctcttttcctctatacacagcgagaccttctgcgtaaagtccggtccgcttcgcgattgctgttgtgctacctccactctctttcccaacctcgcgaaattttactttacagcctggactaagcggcgaagatgctgtcgaagaaccttatcagctcgatatccttgctggcatccacgatccatggtgttgccgccctttccaagggccatgatctgtcgtccgctgggtatatggagacggatcagggcgctacctggctttccgagtctggttctgctagcacaattgaggagatccttggagctggtggtatggacagcgtcaggctaaggtgagttccttgcatcgctctcttcgcacattttactccaagacgacggccacgcacaagcaataggagcgtatcctcatgtatgatctcatgccatggtgtatcttcctgcttgcacgcgagaagggcgtttgttatcttggacaatggacccctttgctccttctactcaaccaggcatgcactcatcacaaagcaaggactgattgacgtgtgttcaagactctggaccggagatgcctacggcctcgactacactcttgaccttgcgaagcgcttttccagcgccggctacaagatctacctggacttgcacctcagcgacacctgggcagacccgtcgaaccaagccaccccagcctccttcgacacctccgacctcgccggctctgtgcgctcctacgtcaaatcgacgctccagtccttctcagacggtggcgtcacgcttgacatcctgtcgatcggcaacgagatcatcaagggcatgctgttcccctcgggcgagatctcgaacaacgacttctcgggcttcgcgaagctgtgggcggcggcgcgtgcgggcgtcgacgatgccgtcgccgcgggcgtgaccaagccgcaggtcatgattcacctgaacaacgggtgggacgaagctaccatgacgtggtggttcaagggcttgttcgatgaaggcaccgtcacccaggacatggtcgacgtcttcggcttctccttctaccccttcttcgacataaaggccaccacttccgcgctgcagaacagcttcaacaccctggcaagcacgtacaacaagccgctgtacgtcgctgagacggactggccgacgagctgctcggacgtcgatctttctgccgatttcgcggtttcggctcagggccagagcgattgggtgggtgcggtggtggatgtgttgaacaatgtgcctgatggattgggtgcgggtatcttctactgggagccaggcttcatcaataacacggcgctgggaagtgactgcgatgacaacatcctgttcgacgtcagctgggacaactggccgaagaccagcgccacggcgagatcgtcggtgaacatgtttgcatagatatggcggactgccctcatctccacttcccgagaaatatgaaggcatgtcgtatggactcagtttcttgaagcggtggttgttgagatctgaattttaccaagaacctcggagggggggaaacagctgttattaagctcgcagtcgact

SEQ ID NO: 353 - DNA, 1068 bp, M. phaseolina
atgctgtcgaagaaccttatcagctcgatatccttgctggcatccacgatccatggtgttgccgccctttccaagggccatgatctgtcgtccgctgggtatatggagacggatcagggcgctacctggctttccgagtctggttctgctagcacaattgaggagatccttggagctggtggtatggacagcgtcaggctaagactctggaccggagatgcctacggcctcgactacactcttgaccttgcgaagcgcttttccagcgccggctacaagatctacctggacttgcacctcagcgacacctgggcagacccgtcgaaccaagccaccccagcctccttcgacacctccgacctcgccggctctgtgcgctcctacgtcaaatcgacgctccagtccttctcagacggtggcgtcacgcttgacatcctgtcgatcggcaacgagatcatcaagggcatgctgttcccctcgggcgagatctcgaacaacgacttctcgggcttcgcgaagctgtgggcggcggcgcgtgcgggcgtcgacgatgccgtcgccgcgggcgtgaccaagccgcaggtcatgattcacctgaacaacgggtgggacgaagctaccatgacgtggtggttcaagggcttgttcgatgaaggcaccgtcacccaggacatggtcgacgtcttcggcttctccttctaccccttcttcgacataaaggccaccacttccgcgctgcagaacagcttcaacaccctggcaagcacgtacaacaagccgctgtacgtcgctgagacggactggccgacgagctgctcggacgtcgatctttctgccgatttcgcggtttcggctcagggccagagcgattgggtgggtgcggtggtggatgtgttgaacaatgtgcctgatggattgggtgcgggtatcttctactgggagccaggcttcatcaataacacggcgctgggaagtgactgcgatgacaacatcctgttcgacgtcagctgggacaactggccgaagaccagcgccacggcgagatcgtcggtgaacatgtttgcatag

SEQ ID NO: 354 - protein, 355 aa, M. phaseolina
MLSKNLISSISLLASTIHGVAALSKGHDLSSAGYMETDQGATWLSESGSASTIEEILGAGGMDSVRLRLWTGDAYGLDYTLDLAKRFSSAGYKIYLDLHLSDTWADPSNQATPASFDTSDLAGSVRSYVKSTLQSFSDGGVTLDILSIGNEIIKGMLFPSGEISNNDFSGFAKLWAAARAGVDDAVAAGVTKPQVMIHLNNGWDEATMTWWFKGLFDEGTVTQDMVDVFGFSFYPFFDIKATTSALQNSFNTLASTYNKPLYVAETDWPTSCSDVDLSADFAVSAQGQSDWVGAVVDVLNNVPDGLGAGIFYWEPGFINNTALGSDCDDNILFDVSWDNWPKTSATARSSVNMFA

SEQ ID NO: 355 - DNA, 1417 bp, M. phaseolina
aaagttgaaacggccttttgccaaacgagtgaatacgagcatttgagatactgacgattccggttcttccgcaatgctaatacacatcgctctgtttccctctttgctgccgttgctcatcactccattcgttccttggtgttagccaacatgttctccacgatggcaacctggctctctctgctcctggtgccatgcgccgttttgggagacaccatcgcctacaaaggcgctgacatttcatccctgttaatgcttgaagcaaagggccaaacctacaagaccacaggcggcgtaacaacgccgctggagaagatacttgcttcctctggcgtcaactctgtccgccaaagggtctgggtcaatccgtcagatggcaactacaatcttgactacaacctgaagttgtcaaagcgggtcaaagccgccggcatgagtatttacctggacctgcatctcagtgacacttgggcagacccgtcgcatcaggtaaggcaactggcaaagcttcatatgcatacatattgacttgacttgtcagaccacacccgctgcctgggatgactccaccattggcacgctgaccaacacggtctatgaatataccaaatccgtctccaactcgtacgccagtgccggcatcacaccgagcatcatctcaattggcaatgagatccgcgctggtttgctgtggcccctgggaggcacttcatcctactacaatatcgcctcgctcctccactctgccgcatggggcatcaaggacagcaacctctcgcccaaaccgaagattatgatccacctggacaatggctgggactccggtacgcaggtctggtggtacaacgaggtgctcggccagggacctctcctgaagacagacttcgatatgatcggcgtttcatactaccccttctacaataaggaggcgtacttgggctccctcaagtactctctgcagcagctcgcctccaaatttggcaagcagctcgtcgtagccgagacgaactggcccgccagctgcccaaaccctgcttacgcgttccccagcgataccagttctattcccaagagcgctgcgggccaggctacttggatcaaggacgtggcaaatatcgtcaagggtgtgagcggtggtgtcggtatctactactgggagccggcctggatcggcaatggtgcgctgggatcaagctgcgctgacaaccttctcgttgatagctccggcaaggcgagagagggtatcgcggccctgggatcggtgtaagcacggaatgtaccatcgtaatgagaaggcgttccgggcgttgtccgccggtcctttcgatctccattcccgatccttcttttatttgggaccctcaacgtacatattaccttctcaagagattgaggcttcgagccacgtttgtcccca

SEQ ID NO: 356 - DNA, 1065 bp, M. phaseolina
atgttctccacgatggcaacctggctctctctgctcctggtgccatgcgccgttttgggagacaccatcgcctacaaaggcgctgacatttcatccctgttaatgcttgaagcaaagggccaaacctacaagaccacaggcggcgtaacaacgccgctggagaagatacttgcttcctctggcgtcaactctgtccgccaaagggtctgggtcaatccgtcagatggcaactacaatcttgactacaacctgaagttgtcaaagcgggtcaaagccgccggcatgagtatttacctggacctgcatctcagtgacacttgggcagacccgtcgcatcagaccacacccgctgcctgggatgactccaccattggcacgctgaccaacacggtctatgaatataccaaatccgtctccaactcgtacgccagtgccggcatcacaccgagcatcatctcaattggcaatgagatccgcgctggtttgctgtggcccctgggaggcacttcatcctactacaatatcgcctcgctcctccactctgccgcatggggcatcaaggacagcaacctctcgcccaaaccgaagattatgatccacctggacaatggctgggactccggtacgcaggtctggtggtacaacgaggtgctcggccagggacctctcctgaagacagacttcgatatgatcggcgtttcatactaccccttctacaataaggaggcgtacttgggctccctcaagtactctctgcagcagctcgcctccaaatttggcaagcagctcgtcgtagccgagacgaactggcccgccagctgcccaaaccctgcttacgcgttccccagcgataccagttctattcccaagagcgctgcgggccaggctacttggatcaaggacgtggcaaatatcgtcaagggtgtgagcggtggtgtcggtatctactactgggagccggcctggatcggcaatggtgcgctgggatcaagctgcgctgacaaccttctcgttgatagctccggcaaggcgagagagggtatcgcggccctgggatcggtgtaa

SEQ ID NO: 357 - protein, 354 aa, M. phaseolina
MFSTMATWLSLLLVPCAVLGDTIAYKGADISSLLMLEAKGQTYKTTGGVTTPLEKILASSGVNSVRQRVWVNPSDGNYNLDYNLKLSKRVKAAGMSIYLDLHLSDTWADPSHQTTPAAWDDSTIGTLTNTVYEYTKSVSNSYASAGITPSIISIGNEIRAGLLWPLGGTSSYYNIASLLHSAAWGIKDSNLSPKPKIMIHLDNGWDSGTQVWWYNEVLGQGPLLKTDFDMIGVSYYPFYNKEAYLGSLKYSLQQLASKFGKQLVVAETNWPASCPNPAYAFPSDTSSIPKSAAGQATWIKDVANIVKGVSGGVGIYYWEPAWIGNGALGSSCADNLLVDSSGKAREGIAALGSV

SEQ ID NO: 358 - DNA, 1497 bp, M. phaseolina
tttttgcctttgcaaccacgatgcctattggaggaatatctttgcaagactcagtctcctcgcccgcccgcacgcgagctctctataagaagagtcaccagctcgcttcttgccaacactgccccgctgtcaggacttatcttcttcaccatgttcatcaccaagcttgtcgctgtgggctcagtcctgttatgcggagcagccgccgctcccaagcccgctcctgtcttctacaaggggcatgacttgtccacgctcaagatcatggaggagagccaggtggtctacattgacactgcgagaaacaacgcaactcggccggcggatgatatccttggtgatgggggcatgaacacagtgcgattgaggttggtccccactccgcaaccgtcccaatagtgatgactgaccagcaacaggctctgggtgaaccctatccccggccagtatgaccttccctacatcctcagcttagcaaagcgcttcgccaacaagggctatcacatctacctcgactaccatttctccgacacctgggccgacccgcagcacaacaacgccccggttgcctggcccaccaccctgcccgaggtggccaaaaccatccgcggctacgtcaacgagaccctgcacgccttcaaggacgagggcatcgacctctccatcgtcagtctgggcaacgaggtccgccacggcatggtctggccgctgggctacgtcgatgtcgacactcctggcgataaggcccgcgcccagaacttcaccggcctggccaccatctacgagagcgcccgccgcggcgtcgacgacgccgttgccggcggcgtgcacaagcccgagatcatgatccacgtcgacaacggctggaacctgaccctccaagaggcctggttcagcgccctcaccgacaccggcatcgtcaagacctccgattgggacgtcttcggcttctccttctaccccttctacggcaccgccgccacctttaagaacttgaagaagacgctcaataccatctcccgcaagtacaagaagcccgtccaggtcgtcgagacggattatcctgttctctgctccggccagtggggacccgttcccgacctcagcgagccctccatccccgtcagcgtcgaaggccagattgagtgggtccacgaggttattgatatcgtgagacaggtgccgcaggggaggggaacgggcgtgcattactgggagccggcctggaccaatttgacgagcttggggagcgcctgcgatgacgctattctgttccaggcggattacagcacatggccggtgacgacggcgtattctaggaagtcggtgaacctgtttaattactaatgtaatgagaagatatcaagcgcaaggcttagacctgctagtagtaagaaaaatttagcctccatgacaacaatagacgtctcctcgcccaaggcgtcccttttttttcgcaggtggggtattggccccttttatggcggtcaatgcgag

SEQ ID NO: 359 - DNA, 1146 bp, M. phaseolina
atgttcatcaccaagcttgtcgctgtgggctcagtcctgttatgcggagcagccgccgctcccaagcccgctcctgtcttctacaaggggcatgacttgtccacgctcaagatcatggaggagagccaggtggtctacattgacactgcgagaaacaacgcaactcggccggcggatgatatccttggtgatgggggcatgaacacagtgcgattgaggctctgggtgaaccctatccccggccagtatgaccttccctacatcctcagcttagcaaagcgcttcgccaacaagggctatcacatctacctcgactaccatttctccgacacctgggccgacccgcagcacaacaacgccccggttgcctggcccaccaccctgcccgaggtggccaaaaccatccgcggctacgtcaacgagaccctgcacgccttcaaggacgagggcatcgacctctccatcgtcagtctgggcaacgaggtccgccacggcatggtctggccgctgggctacgtcgatgtcgacactcctggcgataaggcccgcgcccagaacttcaccggcctggccaccatctacgagagcgcccgccgcggcgtcgacgacgccgttgccggcggcgtgcacaagcccgagatcatgatccacgtcgacaacggctggaacctgaccctccaagaggcctggttcagcgccctcaccgacaccggcatcgtcaagacctccgattgggacgtcttcggcttctccttctaccccttctacggcaccgccgccacctttaagaacttgaagaagacgctcaataccatctcccgcaagtacaagaagcccgtccaggtcgtcgagacggattatcctgttctctgctccggccagtggggacccgttcccgacctcagcgagccctccatccccgtcagcgtcgaaggccagattgagtgggtccacgaggttattgatatcgtgagacaggtgccgcaggggaggggaacgggcgtgcattactgggagccggcctggaccaatttgacgagcttggggagcgcctgcgatgacgctattctgttccaggcggattacagcacatggccggtgacgacggcgtattctaggaagtcggtgaacctgtttaattactaa

SEQ ID NO: 360 - protein, 381 aa, M. phaseolina
MFITKLVAVGSVLLCGAAAAPKPAPVFYKGHDLSTLKIMEESQVVYIDTARNNATRPADDILGDGGMNTVRLRLWVNPIPGQYDLPYILSLAKRFANKGYHIYLDYHFSDTWADPQHNNAPVAWPTTLPEVAKTIRGYVNETLHAFKDEGIDLSIVSLGNEVRHGMVWPLGYVDVDTPGDKARAQNFTGLATIYESARRGVDDAVAGGVHKPEIMIHVDNGWNLTLQEAWFSALTDTGIVKTSDWDVFGFSFYPFYGTAATFKNLKKTLNTISRKYKKPVQVVETDYPVLCSGQWGPVPDLSEPSIPVSVEGQIEWVHEVIDIVRQVPQGRGTGVHYWEPAWTNLTSLGSACDDAILFQADYSTWPVTTAYSRKSVNLFNY

SEQ ID NO: 361 - DNA, 2112 bp, M. phaseolina
aaaccacaattaagcttctcggatagaatcagggccagggcgtcaattccccatctgctcccgttgcttccctacatatatacctttctcctctctctactctcctcttcattctcaaagtgtcccatccgttgcccccttccagcaaagatgtctacattttctaccctcccgtccaccctcgtcctcctcctttcccttcttccactcctcacgtgcgcctggctacccaccagttgcccgcctggcatctccctctcagcctttcgcacaagtcctaccaataaaatccgtggcgtcaacctcggctcgcagttcatcatcgagccgtggatggcgcgccacgagtgggccgcaatgggctgcggcgacgctgaggccgagttccagtgcatcaagaaccagtacggcggcgacatcgcgcgggccagccaggtgtggaagaagcactgggccacgtggatcaacgggacggacctggaccagatggtgcagatggggttgaacacgatcagggtcagttctccgttcggtcccgtcttttgctctaggaattccccgattgagagttcttcggaatgaaataaggttgtgatgtcgtgcaggggttatggcgggggcggatggtcccgggacgaaatgctggcctttgctgatgctcgggtttttggtggggtgataggttccggttggttggtggatgaaggaggatctggtgaggagtggggagtacttccccaaaggcgggttcgcgtacctgcagagcttgtgcgagcatgctgcaagtaatggcatgtatgtcattatcggtcagtgcccggattgccaccaattggcttttacatttgacttcgttccattctaaccgagaagcctgtggtgtcagaaatgcacggggcccccggcacccagaatgctcagcagccgttcacgggaaatgtaattgctctcaaacgagcggcctcaaccgcaaccatatagagcatactgaccagaatccttccctcacccagtactctgacgccacctacttctaccaatccgactaccaatccgcccgcgcctacgttcgtaccgtcccctaccctccacacacgcccactaacctcccctctgcaggacttcctcgtcttcctcacccacgccatccacacgcacccctccttccgcaccgtcggcgccctcggcctcctcaacgagcccgtcttcaacaatcctctctccgccaacagccagtggaccgtctcgcacttctacccctccgccatcgccgccatccgcgccgccgaagctgcgctcggcgtgcgccctcccgccgccctcaccctcaccgtcatggacgacctctggctcgacctgtccggccagtctgacccggccgcgcacctgacagatgcgcagcggcgaggcgtgctgtgggacgagcacaactaccaaagctcgcccgtcgcgaatatgaagcccgaggaggtggtcgcctatgcgtgtggggatgatcgaaggacggggcggcagccgggggaagtaaagtttgtgggggagtggtcgatggcggtgcagcagtgagtagtgtgaataccgttttggtgtgctttttgaaggggaggggctgatgaatcgtgcgtttttctccctttaggaagggcgaaggcttcacgcccgagacggactacaaggcgttttggaaccaatacttcgcggcgctgcagtggaattatgagaggaccaggggctgggtgtggtggacgtggaaggctgaggggggggcgaggctgcagaattggctgcagtggagttataagggtgagtttgtctttcttcgcctttttcctatttgcggacgttgaagcagaaggaagtggtgatgtgctgctaacagttacgtcaggcttagtcgagaatgggattgtgagtaaagatttgaattcgcaattggccttgaatccttgcactggacactgatgcaggcgcggtgcaattatgttggtggttgaagtcagccatcgagaacctactttagtaaatagatagacaagaaacggccggcttccatagtgcagaattgaggtactctgattcttatgggctatgctttgatggtattgtacggta

SEQ ID NO: 362 - DNA, 1281 bp, M. phaseolina
atgtctacattttctaccctcccgtccaccctcgtcctcctcctttcccttcttccactcctcacgtgcgcctggctacccaccagttgcccgcctggcatctccctctcagcctttcgcacaagtcctaccaataaaatccgtggcgtcaacctcggctcgcagttcatcatcgagccgtggatggcgcgccacgagtgggccgcaatgggctgcggcgacgctgaggccgagttccagtgcatcaagaaccagtacggcggcgacatcgcgcgggccagccaggtgtggaagaagcactgggccacgtggatcaacgggacggacctggaccagatggtgcagatggggttgaacacgatcagggttccggttggttggtggatgaaggaggatctggtgaggagtggggagtacttccccaaaggcgggttcgcgtacctgcagagcttgtgcgagcatgctgcaagtaatggcatgtatgtcattatcgaaatgcacggggcccccggcacccagaatgctcagcagccgttcacgggaaattactctgacgccacctacttctaccaatccgactaccaatccgcccgcgcctacgacttcctcgtcttcctcacccacgccatccacacgcacccctccttccgcaccgtcggcgccctcggcctcctcaacgagcccgtcttcaacaatcctctctccgccaacagccagtggaccgtctcgcacttctacccctccgccatcgccgccatccgcgccgccgaagctgcgctcggcgtgcgccctcccgccgccctcaccctcaccgtcatggacgacctctggctcgacctgtccggccagtctgacccggccgcgcacctgacagatgcgcagcggcgaggcgtgctgtgggacgagcacaactaccaaagctcgcccgtcgcgaatatgaagcccgaggaggtggtcgcctatgcgtgtggggatgatcgaaggacggggcggcagccgggggaagtaaagtttgtgggggagtggtcgatggcggtgcagcagaagggcgaaggcttcacgcccgagacggactacaaggcgttttggaaccaatacttcgcggcgctgcagtggaattatgagaggaccaggggctgggtgtggtggacgtggaaggctgaggggggggcgaggctgcagaattggctgcagtggagttataagggcttagtcgagaatgggattgtgagtaaagatttgaattcgcaattggccttgaatccttgcactggacactga

SEQ ID NO: 363 - protein, 426 aa, M. phaseolina
MSTFSTLPSTLVLLLSLLPLLTCAWLPTSCPPGISLSAFRTSPTNKIRGVNLGSQFIIEPWMARHEWAAMGCGDAEAEFQCIKNQYGGDIARASQVWKKHWATWINGTDLDQMVQMGLNTIRVPVGWWMKEDLVRSGEYFPKGGFAYLQSLCEHAASNGMYVIIEMHGAPGTQNAQQPFTGNYSDATYFYQSDYQSARAYDFLVFLTHAIHTHPSFRTVGALGLLNEPVFNNPLSANSQWTVSHFYPSAIAAIRAAEAALGVRPPAALTLTVMDDLWLDLSGQSDPAAHLTDAQRRGVLWDEHNYQSSPVANMKPEEVVAYACGDDRRTGRQPGEVKFVGEWSMAVQQKGEGFTPETDYKAFWNQYFAALQWNYERTRGWVWWTWKAEGGARLQNWLQWSYKGLVENGIVSKDLNSQLALNPCTGH

SEQ ID NO: 364 - DNA, 1617 bp, M. phaseolina
cgaccaaaccagtaccccgcccattccattcttttccgccctgggccatcccaagtcttagcgctcgttcattatatattccgcagaagctgtgtacattattgtgcaggccacacccacactccttctcgatcgcgctattcagccaaaatgaagtactccacaatccttggtctgaccgctgctgtgacccttgcggctgcaagcccggtgaaaagacaatcatcttttgctaaagtcgatggcttgaagttcaatatcgacggtgtaaccaaatactacgccggcacaaatgcttactggcttggattcacaacgggtgatgccgacatcgacactgcgctcgaccggctcaaggaatccggtatcaagcttctccgcatttggggcttcaacgacgtcaacacggttcccactgacggtaggctcatctcagcaacccacaagcgcatgggtctaatgtgatcccagggacggtttggtaccagtcttttgtcgctggccaggacccggtcatcaacaccggtgccaatggcttgcagcgtctggactatgtcgtcaagtcggctgagtctcgcggcatcaagctgattatcaactttgtcaacaactggaccgattacggaggcatggccgcctacatgaagaggtttggcggctcggccaacccggactggtacgccaatgccgacattcaggctcagtacaagaagtacatcaaggccgttgtctcacgctacatcgactctccggccatcttcgcctgggagctggcgaatgagccccgctgcaatggctgtgacaccgtgagaatttccgatactatatccgctgcgctgcgagaagctgacagatatcaagtctgtgatctacgactgggccaaggaaaccagcgcatacatcaagagccttgacgccaaccacctggttaccctcggcgatgaaggattcggagtagcgggtggtgatggcagctatccctaccaggtacgtgcgcgacaataactaccagtggattctttttgacagcgccgcagaagagtgagggtgtcgatttcagcaagaacctcgagatcgatactctcgactacggcacattccatctctacccggattcctgtaagttcgccctactcatcatctggtctcatgatgctgaccgccttttcagggggtcaacccaacgaaccgtttggctccgagtgggttactgctcacggcgctgcctgcgctaccgcaggcaagccatgcatctttgaggagtatggtgtgaagacggacaagtgcaacatagaaggcaaatggcagtcgacggctcttaacaccactggcatcgccgccgatcagttctgggatttcggaaccacgctcagctggggtcaaaccaacaacgatggcaacaccatcttcacgggcacgtccgactgggagtgcctggtgaccaagcacgttgccaacattggttgaagaaaaagacggcccagatgtcaggatttattcttagtttcttgccgatataacgtccttgtacaacaattcacttatgacgtagcagtctcacgatcgaggtgcccatgtgcgccggcactgttagcaagtgttccggcgtctaaattg

SEQ ID NO: 365 - DNA, 1110 bp, M. phaseolina
atgaagtactccacaatccttggtctgaccgctgctgtgacccttgcggctgcaagcccggtgaaaagacaatcatcttttgctaaagtcgatggcttgaagttcaatatcgacggtgtaaccaaatactacgccggcacaaatgcttactggcttggattcacaacgggtgatgccgacatcgacactgcgctcgaccggctcaaggaatccggtatcaagcttctccgcatttggggcttcaacgacgtcaacacggttcccactgacgggacggtttggtaccagtcttttgtcgctggccaggacccggtcatcaacaccggtgccaatggcttgcagcgtctggactatgtcgtcaagtcggctgagtctcgcggcatcaagctgattatcaactttgtcaacaactggaccgattacggaggcatggccgcctacatgaagaggtttggcggctcggccaacccggactggtacgccaatgccgacattcaggctcagtacaagaagtacatcaaggccgttgtctcacgctacatcgactctccggccatcttcgcctgggagctggcgaatgagccccgctgcaatggctgtgacacctctgtgatctacgactgggccaaggaaaccagcgcatacatcaagagccttgacgccaaccacctggttaccctcggcgatgaaggattcggagtagcgggtggtgatggcagctatccctaccagaagagtgagggtgtcgatttcagcaagaacctcgagatcgatactctcgactacggcacattccatctctacccggattcctggggtcaacccaacgaaccgtttggctccgagtgggttactgctcacggcgctgcctgcgctaccgcaggcaagccatgcatctttgaggagtatggtgtgaagacggacaagtgcaacatagaaggcaaatggcagtcgacggctcttaacaccactggcatcgccgccgatcagttctgggatttcggaaccacgctcagctggggtcaaaccaacaacgatggcaacaccatcttcacgggcacgtccgactgggagtgcctggtgaccaagcacgttgccaacattggttga

SEQ ID NO: 366 - protein, 369 aa, M. phaseolina
MKYSTILGLTAAVTLAAASPVKRQSSFAKVDGLKFNIDGVTKYYAGTNAYWLGFTTGDADIDTALDRLKESGIKLLRIWGFNDVNTVPTDGTVWYQSFVAGQDPVINTGANGLQRLDYVVKSAESRGIKLIINFVNNWTDYGGMAAYMKRFGGSANPDWYANADIQAQYKKYIKAVVSRYIDSPAIFAWELANEPRCNGCDTSVIYDWAKETSAYIKSLDANHLVTLGDEGFGVAGGDGSYPYQKSEGVDFSKNLEIDTLDYGTFHLYPDSWGQPNEPFGSEWVTAHGAACATAGKPCIFEEYGVKTDKCNIEGKWQSTALNTTGIAADQFWDFGTTLSWGQTNNDGNTIFTGTSDWECLVTKHVANIG

SEQ ID NO: 367 - DNA, 21 bp, Artificial Sequence
  Synthetic primer
ctgcccatcagtcgctgtgcc

SEQ ID NO: 368 - DNA, 20 bp, Artificial Sequence
  Synthetic primer
tcgctgcatttccttcgcgt

SEQ ID NO: 369 - DNA, 22 bp, Artificial Sequence
  Synthetic primer
tagacaccttccccgccttggt

SEQ ID NO: 370 - DNA, 21 bp, Artificial Sequence
  Synthetic primer
ccgctcccttatggccctgct

SEQ ID NO: 371 - DNA, 20 bp, Artificial Sequence
  Synthetic primer
cgctagccgctcagtcacca

SEQ ID NO: 372 - DNA, 22 bp, Artificial Sequence
  Synthetic primer
gcgatccgcttagaagaggcgg

SEQ ID NO: 373 - DNA, 21 bp, Artificial Sequence
  Synthetic primer
ttgcggctagcccgtagcctt

SEQ ID NO: 374 - DNA, 20 bp, Artificial Sequence
  Synthetic primer
gggcactggaagcacggtgt

SEQ ID NO: 375 - DNA, 21 bp, Artificial Sequence
  Synthetic primer
atacgcgatccgccgtgttgt

SEQ ID NO: 376 - DNA, 21 bp, Artificial Sequence
  Synthetic primer
gcgcagcaggctctctagcac

SEQ ID NO: 377 - DNA, 20 bp, Artificial Sequence
  Synthetic primer
acggcccggtgcctttttga

SEQ ID NO: 378 - DNA, 20 bp, Artificial Sequence
  Synthetic primer
ctggaccgcccacgctcaga

SEQ ID NO: 379 - DNA, 20 bp, Artificial Sequence
  Synthetic primer
gcccgctgatcgagcattga

SEQ ID NO: 380 - DNA, 20 bp, Artificial Sequence
  Synthetic primer
gcaggtgggcagtgaaaccc

SEQ ID NO: 381 - DNA, 21 bp, Artificial Sequence
  Synthetic primer
atgcggtcggggaacattgcg

SEQ ID NO: 382 - DNA, 20 bp, Artificial Sequence
  Synthetic primer
ctccgctcagctggggcact

SEQ ID NO: 383 - DNA, 21 bp, Artificial Sequence
  Synthetic primer
ccctcccctaccccttgccat

SEQ ID NO: 384 - DNA, 21 bp, Artificial Sequence
  Synthetic primer
catgctctccgctcgcgctta

SEQ ID NO: 385 - DNA, 22 bp, Artificial Sequence
  Synthetic primer
agcggtctgaacttccgggaca

SEQ ID NO: 386 - DNA, 20 bp, Artificial Sequence
  Synthetic primer
tcgccagccggaaggcagtt

SEQ ID NO: 387 - DNA, 23 bp, Artificial Sequence
  Synthetic primer
tctgactgctcgacagacctgct

SEQ ID NO: 388 - DNA, 22 bp, Artificial Sequence
  Synthetic primer
gcgaactggtggatgctcaggc

SEQ ID NO: 389 - DNA, 22 bp, Artificial Sequence
  Synthetic primer
gctcccgccttgccattccttt

SEQ ID NO: 390 - DNA, 21 bp, Artificial Sequence
  Synthetic primer
caagaacccgcctcgcaaacg

SEQ ID NO: 391 - DNA, 21 bp, Artificial Sequence
  Synthetic primer
tccgggggaatgctgcgatca

SEQ ID NO: 392 - DNA, 22 bp, Artificial Sequence
  Synthetic primer
cacccgccgtccaatgttagcc

SEQ ID NO: 393 - DNA, 20 bp, Artificial Sequence
  Synthetic primer
cggcgattttgctcccaccg

SEQ ID NO: 394 - DNA, 20 bp, Artificial Sequence
  Synthetic primer
ccattccacagggcgggttt

SEQ ID NO: 395 - DNA, 21 bp, Artificial Sequence
  Synthetic primer
aagagggacgctcaggggagt

SEQ ID NO: 396 - DNA, 21 bp, Artificial Sequence
  Synthetic primer
ggccctcaagcattcgcccaa

SEQ ID NO: 397 - DNA, 21 bp, Artificial Sequence
  Synthetic primer
acccgccgaacacagcaaaca

SEQ ID NO: 398 - DNA, 20 bp, Artificial Sequence
  Synthetic primer
gtccccgtcaaggcccaacc

SEQ ID NO: 399 - DNA, 20 bp, Artificial Sequence
  Synthetic primer
atcaccaacggcgcgcagaa

SEQ ID NO: 400 - DNA, 20 bp, Artificial Sequence
  Synthetic primer
gccgcgtacctcctcgcatc

SEQ ID NO: 401 - DNA, 20 bp, Artificial Sequence
  Synthetic primer
gagcccagtgagaccctgct

SEQ ID NO: 402 - DNA, 20 bp, Artificial Sequence
  Synthetic primer
ggggcgttgccctgatgtga

SEQ ID NO: 403 - DNA, 20 bp, Artificial Sequence
  Synthetic primer
cgctacggcggcatctgtga

SEQ ID NO: 404 - DNA, 21 bp, Artificial Sequence
  Synthetic primer
tgagttacccggcggttgtcc

SEQ ID NO: 405 - DNA, 22 bp, Artificial Sequence
  Synthetic primer
caagcctggacgatactcccga

SEQ ID NO: 406 - DNA, 22 bp, Artificial Sequence
  Synthetic primer
cttcccacctccactcaaccca

SEQ ID NO: 407 - DNA, 20 bp, Artificial Sequence
  Synthetic primer
cacctgaactcttgcccgct

SEQ ID NO: 408 - DNA, 20 bp, Artificial Sequence
  Synthetic primer
cacaacgctcaaggcgcaaa

SEQ ID NO: 409 - DNA, 20 bp, Artificial Sequence
  Synthetic primer
gtgccggtcgttacggttca

SEQ ID NO: 410 - DNA, 21 bp, Artificial Sequence
  Synthetic primer
cgtgtacgctggtggtcatcg

SEQ ID NO: 411 - DNA, 20 bp, Artificial Sequence
  Synthetic primer
acttgcctaatgacccccgc

SEQ ID NO: 412 - DNA, 20 bp, Artificial Sequence
  Synthetic primer
tcacgcaaccggactctcca

SEQ ID NO: 413 - DNA, 20 bp, Artificial Sequence
  Synthetic primer
cttgcgcttcgctgaccacg

SEQ ID NO: 414 - DNA, 20 bp, Artificial Sequence
  Synthetic primer
gcaccacctctctcgatgcc

SEQ ID NO: 415 - DNA, 20 bp, Artificial Sequence
  Synthetic primer
ccgcttctctcgtcgttgcc

SEQ ID NO: 416 - DNA, 21 bp, Artificial Sequence
  Synthetic primer
tgcagggagaacagtgtagcg

SEQ ID NO: 417 - DNA, 21 bp, Artificial Sequence
  Synthetic primer
tcagcatggacaacgccctgg

SEQ ID NO: 418 - DNA, 21 bp, Artificial Sequence
  Synthetic primer
gattgtgacggtggcctcgcc

SEQ ID NO: 419 - DNA, 21 bp, Artificial Sequence
  Synthetic primer
gcccacgcctgctcgttcaat

SEQ ID NO: 420 - DNA, 21 bp, Artificial Sequence
  Synthetic primer
acccaccactcccaccgatcc

SEQ ID NO: 421 - DNA, 20 bp, Artificial Sequence
  Synthetic primer
tggcccgaccaccaacatgc

SEQ ID NO: 422 - DNA, 20 bp, Artificial Sequence
  Synthetic primer
cgccccggaacgtggaaagg

SEQ ID NO: 423 - DNA, 20 bp, Artificial Sequence
  Synthetic primer
tgacgagccatgaggtccgc

SEQ ID NO: 424 - DNA, 20 bp, Artificial Sequence
  Synthetic primer
cgcttggacgtcgatgcagt

SEQ ID NO: 425 - DNA, 21 bp, Artificial Sequence
  Synthetic primer
tgcaggcccctttcatctgcc

SEQ ID NO: 426 - DNA, 20 bp, Artificial Sequence
  Synthetic primer
accgctattccggcgctctc

SEQ ID NO: 427 - DNA, 20 bp, Artificial Sequence
  Synthetic primer
accgctgccagtcactgctc

SEQ ID NO: 428 - DNA, 21 bp, Artificial Sequence
  Synthetic primer
ggcatttcgagcccccaatcg

SEQ ID NO: 429 - DNA, 20 bp, Artificial Sequence
  Synthetic primer
ccacggactccgctcaccag

SEQ ID NO: 430 - DNA, 21 bp, Artificial Sequence
  Synthetic primer
gacggctcgtccagatcctca

SEQ ID NO: 431 - DNA, 21 bp, Artificial Sequence
  Synthetic primer
acaaccgagatggcagaggca

SEQ ID NO: 432 - DNA, 20 bp, Artificial Sequence
  Synthetic primer
cgccgaaaacctgctcgcaa

SEQ ID NO: 433 - DNA, 20 bp, Artificial Sequence
  Synthetic primer
acgacgcatacgcggcgaag

SEQ ID NO: 434 - DNA, 21 bp, Artificial Sequence
  Synthetic primer
gcctggtaggcccccagaaac

SEQ ID NO: 435 - DNA, 21 bp, Artificial Sequence
  Synthetic primer
cgccttcggtagtctccgctt

SEQ ID NO: 436 - DNA, 20 bp, Artificial Sequence
  Synthetic primer
cggtttggcaagatggcggc

SEQ ID NO: 437 - DNA, 20 bp, Artificial Sequence
  Synthetic primer
ttgcgacggagatgcgtggg

SEQ ID NO: 438 - DNA, 21 bp, Artificial Sequence
  Synthetic primer
ctgcatccccctgccattagc

SEQ ID NO: 439 - DNA, 21 bp, Artificial Sequence
  Synthetic primer
atatcgaccgtctcgcggcca

SEQ ID NO: 440 - DNA, 21 bp, Artificial Sequence
  Synthetic primer
gatcagggacggcggggaaga

SEQ ID NO: 441 - DNA, 21 bp, Artificial Sequence
  Synthetic primer
atcaccgccaaaacaccacgc

SEQ ID NO: 442 - DNA, 21 bp, Artificial Sequence
  Synthetic primer
ttacgccaacgtcgcactcag

SEQ ID NO: 443 - DNA, 21 bp, Artificial Sequence
  Synthetic primer
cgggttggagccgcagtgatt

SEQ ID NO: 444 - DNA, 21 bp, Artificial Sequence
  Synthetic primer
aaaccgtcagcgtcccctcca

SEQ ID NO: 445 - DNA, 21 bp, Artificial Sequence
  Synthetic primer
tcccttggccctcctccgaac

SEQ ID NO: 446 - DNA, 21 bp, Artificial Sequence
  Synthetic primer
ccctgctttcggctaccgctc

SEQ ID NO: 447 - DNA, 20 bp, Artificial Sequence
  Synthetic primer
gtgcgccggacctaccgaga

SEQ ID NO: 448 - DNA, 21 bp, Artificial Sequence
  Synthetic primer
caggagtgcgctctggacgga

SEQ ID NO: 449 - DNA, 21 bp, Artificial Sequence
  Synthetic primer
tcgcgggatgctcaccgtact

SEQ ID NO: 450 - DNA, 22 bp, Artificial Sequence
  Synthetic primer
cgcattcactcactgccaccct

SEQ ID NO: 451 - DNA, 20 bp, Artificial Sequence
  Synthetic primer
ccatcatgccgtccgcagca

SEQ ID NO: 452 - DNA, 22 bp, Artificial Sequence
  Synthetic primer
cgaaacacggaaacacccgcag

SEQ ID NO: 453 - DNA, 20 bp, Artificial Sequence
  Synthetic primer
ttccaatggcaccttcgccg

SEQ ID NO: 454 - DNA, 20 bp, Artificial Sequence
  Synthetic primer
acacctggcctacccgtctc

SEQ ID NO: 455 - DNA, 20 bp, Artificial Sequence
  Synthetic primer
catcccctgctccggcttcc

SEQ ID NO: 456 - DNA, 24 bp, Artificial Sequence
  Synthetic primer
cgtcgagaattggtccgtatgtcc

SEQ ID NO: 457 - DNA, 20 bp, Artificial Sequence
  Synthetic primer
ggtggagcgcatcgtcaggg

SEQ ID NO: 458 - DNA, 20 bp, Artificial Sequence
  Synthetic primer
ccacgcgctcagtccgcttt

SEQ ID NO: 459 - DNA, 22 bp, Artificial Sequence
  Synthetic primer
gtctccacgcctcttccgtcct

SEQ ID NO: 460 - DNA, 21 bp, Artificial Sequence
  Synthetic primer
ttggttgggattgcgggcgtt

SEQ ID NO: 461 - DNA, 20 bp, Artificial Sequence
  Synthetic primer
cggctccacattccagcccc

SEQ ID NO: 462 - DNA, 24 bp, Artificial Sequence
  Synthetic primer
ggaacggagagcctccagttatgc

SEQ ID NO: 463 - DNA, 20 bp, Artificial Sequence
  Synthetic primer
actgcagacaccacggacga

SEQ ID NO: 464 - DNA, 20 bp, Artificial Sequence
  Synthetic primer
tgctgacgcggctgttacga

SEQ ID NO: 465 - DNA, 22 bp, Artificial Sequence
  Synthetic primer
ccccatcctccaacggtcctca

SEQ ID NO: 466 - DNA, 21 bp, Artificial Sequence
  Synthetic primer
ccgccttcccgaaacagctcg

SEQ ID NO: 467 - DNA, 20 bp, Artificial Sequence
  Synthetic primer
attagctgcaccgtccccgc

SEQ ID NO: 468 - DNA, 22 bp, Artificial Sequence
  Synthetic primer
acctcgcagcccaatgcaagac

SEQ ID NO: 469 - DNA, 20 bp, Artificial Sequence
  Synthetic primer
cccccagcgcattctgaggc

SEQ ID NO: 470 - DNA, 21 bp, Artificial Sequence
  Synthetic primer
accagcccagacagaacccct

SEQ ID NO: 471 - DNA, 20 bp, Artificial Sequence
  Synthetic primer
cgctggcgcagttggatgta

SEQ ID NO: 472 - DNA, 20 bp, Artificial Sequence
  Synthetic primer
cgctcatgcgctttgatgcc

SEQ ID NO: 473 - DNA, 20 bp, Artificial Sequence
  Synthetic primer
tcccgcccagcagctacgat

SEQ ID NO: 474 - DNA, 21 bp, Artificial Sequence
  Synthetic primer
tgcggtagaagggctgcgatg

SEQ ID NO: 475 - DNA, 20 bp, Artificial Sequence
  Synthetic primer
gcgggagcaaccgtctttct

SEQ ID NO: 476 - DNA, 20 bp, Artificial Sequence
  Synthetic primer
attccgtcccggcacctcag

SEQ ID NO: 477 - DNA, 21 bp, Artificial Sequence
  Synthetic primer
atcctcagcctcgcattgggt

SEQ ID NO: 478 - DNA, 21 bp, Artificial Sequence
  Synthetic primer
cgaaaggttcgtgcctcccac

SEQ ID NO: 479 - DNA, 20 bp, Artificial Sequence
  Synthetic primer
cagctgtacttcagcgcacg

SEQ ID NO: 480 - DNA, 23 bp, Artificial Sequence
  Synthetic primer
ttaatgagaatggctgcctgccg

SEQ ID NO: 481 - DNA, 20 bp, Artificial Sequence
  Synthetic primer
accagcccgccaccatgttc

SEQ ID NO: 482 - DNA, 20 bp, Artificial Sequence
  Synthetic primer
cgcggttgctctcaggctgt

SEQ ID NO: 483 - DNA, 20 bp, Artificial Sequence
  Synthetic primer
cgggtcgaaggagctcacgc

SEQ ID NO: 484 - DNA, 20 bp, Artificial Sequence
  Synthetic primer
gggcgaaggatcagacgcgg

SEQ ID NO: 485 - DNA, 21 bp, Artificial Sequence
  Synthetic primer
ttggatggccgccagcatcat

SEQ ID NO: 486 - DNA, 21 bp, Artificial Sequence
  Synthetic primer
cagaccccttcggaccccgta

SEQ ID NO: 487 - DNA, 20 bp, Artificial Sequence
  Synthetic primer
ccagtagcccgccgtctggt

SEQ ID NO: 488 - DNA, 21 bp, Artificial Sequence
  Synthetic primer
ccgattcgggctgatccgcaa

SEQ ID NO: 489 - DNA, 22 bp, Artificial Sequence
  Synthetic primer
cgtgtgctgcgcaaagaatggc

SEQ ID NO: 490 - DNA, 22 bp, Artificial Sequence
  Synthetic primer
cgaaatatcgccgcaagcccac

SEQ ID NO: 491 - DNA, 20 bp, Artificial Sequence
  Synthetic primer
acgcttgctccgattccgcc

SEQ ID NO: 492 - DNA, 21 bp, Artificial Sequence
  Synthetic primer
tctacgccgtgaaggcctcgt

SEQ ID NO: 493 - DNA, 21 bp, Artificial Sequence
  Synthetic primer
aaccgcaaccatgacctcggc

SEQ ID NO: 494 - DNA, 21 bp, Artificial Sequence
  Synthetic primer
agcgagtgccatccgagcttc

SEQ ID NO: 495 - DNA, 21 bp, Artificial Sequence
  Synthetic primer
gcgccttcttcgcaccgtcat

SEQ ID NO: 496 - DNA, 21 bp, Artificial Sequence
  Synthetic primer
atcctgccgcgacgctcaaag

SEQ ID NO: 497 - DNA, 21 bp, Artificial Sequence
  Synthetic primer
ttgcagccagcctccttctct

SEQ ID NO: 498 - DNA, 21 bp, Artificial Sequence
  Synthetic primer
agcgaacccctcatcgtctcg

SEQ ID NO: 499 - DNA, 20 bp, Artificial Sequence
  Synthetic primer
cccgctgaccgtccaaagcc

SEQ ID NO: 500 - DNA, 20 bp, Artificial Sequence
  Synthetic primer
acgcgttccaaagcgggtca

SEQ ID NO: 501 - DNA, 21 bp, Artificial Sequence
  Synthetic primer
tgccacgacgcgaattgatcg

SEQ ID NO: 502 - DNA, 20 bp, Artificial Sequence
  Synthetic primer
agccgccacgcctcaaactc

SEQ ID NO: 503 - DNA, 21 bp, Artificial Sequence
  Synthetic primer
actggtccccatggtcctgct

SEQ ID NO: 504 - DNA, 21 bp, Artificial Sequence
  Synthetic primer
ttgtcaggctgtttgcgcagc

SEQ ID NO: 505 - DNA, 20 bp, Artificial Sequence
  Synthetic primer
catgtcccgcttcgcgtact

SEQ ID NO: 506 - DNA, 21 bp, Artificial Sequence
  Synthetic primer
cttggcctttgcgtcccgaat

SEQ ID NO: 507 - DNA, 20 bp, Artificial Sequence
  Synthetic primer
ggcggtacgagggtcacggg

SEQ ID NO: 508 - DNA, 20 bp, Artificial Sequence
  Synthetic primer
tgtaccgcaccccgctgttt

SEQ ID NO: 509 - DNA, 20 bp, Artificial Sequence
  Synthetic primer
gctgtaggttcgtcgccctc

SEQ ID NO: 510 - DNA, 20 bp, Artificial Sequence
  Synthetic primer
cagtcggcagcccgtcataa

SEQ ID NO: 511 - DNA, 20 bp, Artificial Sequence
  Synthetic primer
cccgccgctctggatagtcg

SEQ ID NO: 512 - DNA, 20 bp, Artificial Sequence
  Synthetic primer
cctcccaccaagccccaagc

SEQ ID NO: 513 - DNA, 23 bp, Artificial Sequence
  Synthetic primer
cgggtgttgctgtttgtcttcgt

SEQ ID NO: 514 - DNA, 20 bp, Artificial Sequence
  Synthetic primer
ccgccgttccaagcagaggg

SEQ ID NO: 515 - DNA, 22 bp, Artificial Sequence
  Synthetic primer
tccccctcaagaagctgccagt

SEQ ID NO: 516 - DNA, 22 bp, Artificial Sequence
  Synthetic primer
tggccatcctcttgccctcgtt

SEQ ID NO: 517 - DNA, 22 bp, Artificial Sequence
  Synthetic primer
tccttcgagggctgtccgatcc

SEQ ID NO: 518 - DNA, 21 bp, Artificial Sequence
  Synthetic primer
tgcgcctgttccttacgccac

SEQ ID NO: 519 - DNA, 21 bp, Artificial Sequence
  Synthetic primer
gccatggaggtgtgtgggagc

SEQ ID NO: 520 - DNA, 22 bp, Artificial Sequence
  Synthetic primer
ccacgtggtcagcgcttgaggc

SEQ ID NO: 521 - DNA, 20 bp, Artificial Sequence
  Synthetic primer
ggccgccgacttcaagctct

SEQ ID NO: 522 - DNA, 21 bp, Artificial Sequence
  Synthetic primer
tgatgcgcgctccttagccag

SEQ ID NO: 523 - DNA, 21 bp, Artificial Sequence
  Synthetic primer
ttggttcgcctccagaccgct

SEQ ID NO: 524 - DNA, 21 bp, Artificial Sequence
  Synthetic primer
gcagcgggaggttctcttcgc

SEQ ID NO: 525 - DNA, 19 bp, Artificial Sequence
  Synthetic primer
atggacgaccggcccgact

SEQ ID NO: 526 - DNA, 22 bp, Artificial Sequence
  Synthetic primer
catgccgcgagaacgagtccac

SEQ ID NO: 527 - DNA, 24 bp, Artificial Sequence
  Synthetic primer
acgctcgctttcttgtccaaagca

SEQ ID NO: 528 - DNA, 25 bp, Artificial Sequence
  Synthetic primer
acctggttgagcggtaatagagctt

SEQ ID NO: 529 - DNA, 20 bp, Artificial Sequence
  Synthetic primer
gcaatgggcctcgacggctt

SEQ ID NO: 530 - DNA, 20 bp, Artificial Sequence
  Synthetic primer
atgcacccaccccaccccat

SEQ ID NO: 531 - DNA, 20 bp, Artificial Sequence
  Synthetic primer
atcatggcttccagtcgcgg

SEQ ID NO: 532 - DNA, 20 bp, Artificial Sequence
  Synthetic primer
atccccggttgacatccgct

SEQ ID NO: 533 - DNA, 20 bp, Artificial Sequence
  Synthetic primer
cgctgccgaactctgccagt

SEQ ID NO: 534 - DNA, 20 bp, Artificial Sequence
  Synthetic primer
gcgtgtcccacgctgatgct

SEQ ID NO: 535 - DNA, 20 bp, Artificial Sequence
  Synthetic primer
tgtcaccctcgtgctctgct

SEQ ID NO: 536 - DNA, 20 bp, Artificial Sequence
  Synthetic primer
aatggctcgcgaaagcgcag

SEQ ID NO: 537 - DNA, 20 bp, Artificial Sequence
  Synthetic primer
gtggattcgggctgaccccc

SEQ ID NO: 538 - DNA, 21 bp, Artificial Sequence
  Synthetic primer
gctgcctttgcatggacgcag

SEQ ID NO: 539 - DNA, 20 bp, Artificial Sequence
  Synthetic primer
tggaccttcatggaccgcgt

SEQ ID NO: 540 - DNA, 22 bp, Artificial Sequence
  Synthetic primer
tgcttcggctctccatgaacca

SEQ ID NO: 541 - DNA, 20 bp, Artificial Sequence
  Synthetic primer
acacccgcaccacaatgccg

SEQ ID NO: 542 - DNA, 20 bp, Artificial Sequence
  Synthetic primer
cggcccgctgtgtacaaggt

SEQ ID NO: 543 - DNA, 21 bp, Artificial Sequence
  Synthetic primer
tccgtcgattgtggccttcca

SEQ ID NO: 544 - DNA, 20 bp, Artificial Sequence
  Synthetic primer
agctcccacgcaccctcaca

SEQ ID NO: 545 - DNA, 20 bp, Artificial Sequence
  Synthetic primer
atcctcccctagccatgccg

SEQ ID NO: 546 - DNA, 20 bp, Artificial Sequence
  Synthetic primer
ggtcactgcccacctcctct

SEQ ID NO: 547 - DNA, 21 bp, Artificial Sequence
  Synthetic primer
cgcagatgactgtcgcagacc

SEQ ID NO: 548 - DNA, 20 bp, Artificial Sequence
  Synthetic primer
gccctaccacccactttcgc

SEQ ID NO: 549 - DNA, 20 bp, Artificial Sequence
  Synthetic primer
ccgtcgcacgaccgggaaac

SEQ ID NO: 550 - DNA, 22 bp, Artificial Sequence
  Synthetic primer
aggtcatgccatccagtgctga

SEQ ID NO: 551 - DNA, 24 bp, Artificial Sequence
  Synthetic primer
cacaggctgtaagacctacctccg

SEQ ID NO: 552 - DNA, 25 bp, Artificial Sequence
  Synthetic primer
acagcagaggtgactggataagggt

SEQ ID NO: 553 - DNA, 20 bp, Artificial Sequence
  Synthetic primer
gccggcttccttccgatccc

SEQ ID NO: 554 - DNA, 23 bp, Artificial Sequence
  Synthetic primer
cgacttcttcaagtctccccgcc

SEQ ID NO: 555 - DNA, 21 bp, Artificial Sequence
  Synthetic primer
cgtttccacccgcaggaagca

SEQ ID NO: 556 - DNA, 21 bp, Artificial Sequence
  Synthetic primer
atgagcgctcgcgtcggtagt

SEQ ID NO: 557 - DNA, 21 bp, Artificial Sequence
  Synthetic primer
agcgaaggcgaccacagacca

SEQ ID NO: 558 - DNA, 21 bp, Artificial Sequence
  Synthetic primer
ttctgagccaccgcctcctgg

SEQ ID NO: 559 - DNA, 21 bp, Artificial Sequence
  Synthetic primer
aaacgcgaaagtggggcagga

SEQ ID NO: 560 - DNA, 20 bp, Artificial Sequence
  Synthetic primer
cggcccagcagatccgcata

SEQ ID NO: 561 - DNA, 20 bp, Artificial Sequence
  Synthetic primer
atgcagtgccgaggcggttg

SEQ ID NO: 562 - DNA, 21 bp, Artificial Sequence
  Synthetic primer
aagcacgattgcttgggcggt

SEQ ID NO: 563 - DNA, 21 bp, Artificial Sequence
  Synthetic primer
ccacgatgctgtcctccctgg

SEQ ID NO: 564 - DNA, 21 bp, Artificial Sequence
  Synthetic primer
aacggatgatcgccggcttga

SEQ ID NO: 565 - DNA, 20 bp, Artificial Sequence
  Synthetic primer
gccccagcgatgctgtgcta

SEQ ID NO: 566 - DNA, 21 bp, Artificial Sequence
  Synthetic primer
tgcgcggaatcaaccccacac

SEQ ID NO: 567 - DNA, 21 bp, Artificial Sequence
  Synthetic primer
ctgcccaacaaagcctcccca

SEQ ID NO: 568 - DNA, 21 bp, Artificial Sequence
  Synthetic primer
attaagccgccttcgccgcaa

SEQ ID NO: 569 - DNA, 21 bp, Artificial Sequence
  Synthetic primer
tgctgctcgacttgctcgcat

SEQ ID NO: 570 - DNA, 24 bp, Artificial Sequence
  Synthetic primer
actcctcatcctccctacaaggca

SEQ ID NO: 571 - DNA, 20 bp, Artificial Sequence
  Synthetic primer
ggctggagcggtgacagcag

SEQ ID NO: 572 - DNA, 20 bp, Artificial Sequence
  Synthetic primer
cacacacgccccgcctacag

SEQ ID NO: 573 - DNA, 21 bp, Artificial Sequence
  Synthetic primer
cccccacattgcgtccaggag

SEQ ID NO: 574 - DNA, 20 bp, Artificial Sequence
  Synthetic primer
catcccaaggaagggcagcg

SEQ ID NO: 575 - DNA, 20 bp, Artificial Sequence
  Synthetic primer
tccaggtcgtacgggcaagc

SEQ ID NO: 576 - DNA, 20 bp, Artificial Sequence
  Synthetic primer
cgcatgccagcgacgctacg

SEQ ID NO: 577 - DNA, 20 bp, Artificial Sequence
  Synthetic primer
cgtcgagttgcaatgcccgc

SEQ ID NO: 578 - DNA, 20 bp, Artificial Sequence
  Synthetic primer
gcggccccgtctcctaaagc

SEQ ID NO: 579 - DNA, 20 bp, Artificial Sequence
  Synthetic primer
ttgtacgacctgctccgccg

SEQ ID NO: 580 - DNA, 20 bp, Artificial Sequence
  Synthetic primer
aggtcggtgccgcgctcaaa

SEQ ID NO: 581 - DNA, 20 bp, Artificial Sequence
  Synthetic primer
cgagctccctgttccctggc

SEQ ID NO: 582 - DNA, 20 bp, Artificial Sequence
  Synthetic primer
tcacgcatccggctccccag

SEQ ID NO: 583 - DNA, 21 bp, Artificial Sequence
  Synthetic primer
agacatgcgcgtcgctcttcc

SEQ ID NO: 584 - DNA, 20 bp, Artificial Sequence
  Synthetic primer
ccagtccgctccgccagaat

SEQ ID NO: 585 - DNA, 21 bp, Artificial Sequence
  Synthetic primer
gcctgcatccatccacccgtc

SEQ ID NO: 586 - DNA, 22 bp, Artificial Sequence
  Synthetic primer
ccatagccacaccacaccgtcc

SEQ ID NO: 587 - DNA, 20 bp, Artificial Sequence
  Synthetic primer
cttctcaccgccgcgctgtt

SEQ ID NO: 588 - DNA, 22 bp, Artificial Sequence
  Synthetic primer
cacgccgtcttgctatgcatcc

SEQ ID NO: 589 - DNA, 20 bp, Artificial Sequence
  Synthetic primer
cctccacgatggcgcggttg

SEQ ID NO: 590 - DNA, 21 bp, Artificial Sequence
  Synthetic primer
aggggaacagacggcaagcac

SEQ ID NO: 591 - DNA, 20 bp, Artificial Sequence
  Synthetic primer
ccagactccgtgcttcggga

SEQ ID NO: 592 - DNA, 21 bp, Artificial Sequence
  Synthetic primer
catattgcggcatcgccaccc

SEQ ID NO: 593 - DNA, 20 bp, Artificial Sequence
  Synthetic primer
ggatttcccggggcgtgact

SEQ ID NO: 594 - DNA, 20 bp, Artificial Sequence
  Synthetic primer
aggcagtcggtggacagctc

SEQ ID NO: 595 - DNA, 20 bp, Artificial Sequence
  Synthetic primer
gccccacctttcccgctgag

SEQ ID NO: 596 - DNA, 21 bp, Artificial Sequence
  Synthetic primer
acgtagcggccgacatcttga

SEQ ID NO: 597 - DNA, 20 bp, Artificial Sequence
  Synthetic primer
tgctctccgcactgcgtttt

SEQ ID NO: 598 - DNA, 20 bp, Artificial Sequence
  Synthetic primer
cctcatcactcggctcccgt

SEQ ID NO: 599 - DNA, 20 bp, Artificial Sequence
  Synthetic primer
ccttcaccggcagccatgcg

SEQ ID NO: 600 - DNA, 21 bp, Artificial Sequence
  Synthetic primer
acaccgaggctgcaagccaaa

SEQ ID NO: 601 - DNA, 20 bp, Artificial Sequence
  Synthetic primer
acagcctggactaagcggcg

SEQ ID NO: 602 - DNA, 21 bp, Artificial Sequence
  Synthetic primer
gtggagatgagggcagtccgc

SEQ ID NO: 603 - DNA, 20 bp, Artificial Sequence
  Synthetic primer
gcgccgttttgggagacacc

SEQ ID NO: 604 - DNA, 21 bp, Artificial Sequence
  Synthetic primer
cgcccggaacgccttctcatt

SEQ ID NO: 605 - DNA, 20 bp, Artificial Sequence
  Synthetic primer
acactgccccgctgtcagga

SEQ ID NO: 606 - DNA, 20 bp, Artificial Sequence
  Synthetic primer
gggccaataccccacctgcg

SEQ ID NO: 607 - DNA, 20 bp, Artificial Sequence
  Synthetic primer
gggccagggcgtcaattccc

SEQ ID NO: 608 - DNA, 20 bp, Artificial Sequence
  Synthetic primer
cgcgcctgcatcagtgtcca

SEQ ID NO: 609 - DNA, 20 bp, Artificial Sequence
  Synthetic primer
caggccacacccacactcct

SEQ ID NO: 610 - DNA, 20 bp, Artificial Sequence
  Synthetic primer
tgggcacctcgatcgtgaga

What is claimed is:

1. An isolated nucleic acid molecule comprising a cDNA which has at least 95% sequence identity to the nucleotide sequence set forth in SEQ ID NO: 2, wherein said cDNA encodes a β-1,4-endoglucanase.

2. The isolated nucleic acid molecule of claim 1, which is single-stranded.

3. The isolated nucleic acid molecule of claim 1, uninterrupted by a stop codon within the cDNA.

4. A recombinant construct comprising the isolated nucleic acid molecule of claim 1.

5. An expression construct comprising a nucleic acid sequence which has at least 95% sequence identity to the nucleic acid sequence set forth in SEQ ID NO: 2, wherein said nucleic acid sequence encodes a β-1,4-endoglucanase and the nucleic acid sequence is operatively associated with a regulatory nucleotide sequence containing transcriptional or translational regulatory signals or both that controls expression of the nucleic acid sequence in a host cell.

6. A genetically engineered host cell comprising the isolated nucleic acid molecule of claim 1.

7. A method of making a polypeptide comprising the steps of:

i. culturing a cell transformed with the expression construct of claim 5 under appropriate conditions to produce the polypeptide, and ii. isolating the polypeptide.

8. A transformant, comprising the expression construct of claim 5, wherein said transformant produces an enzyme which accelerates cellulolytic degradation.

9. A transgenic fungi of *M. phaseolina* with enhanced cellulolytic degradation, comprising the expression construct of claim 5.

10. The isolated nucleic acid molecule of claim 1, wherein said cDNA has at least 98% sequence identity to the nucleotide sequence set for in SEQ ID NO: 2.

11. The isolated nucleic acid molecule of claim 1, wherein said cDNA has at least 100% sequence identity to the nucleotide sequence set for in SEQ ID NO: 2.

12. The expression construct of claim 5, wherein said nucleic acid sequence has at least 98% sequence identity to the nucleotide sequence set forth in SEQ ID NO: 2.

13. The expression construct of claim 5, wherein said nucleic acid sequence has at least 100% sequence identity to the nucleotide sequence set forth in SEQ ID NO: 2.

* * * * *